United States Patent 9,283,287 (MODIFIED POLYNUCLEOTIDES FOR THE PRODUCTION OF NUCLEAR PROTEINS) - sequence listing, part 14

SEQ ID NO: 25257 - DNA, 213 bp, Artificial Sequence
  Description of Artificial Sequence: Synthetic coding sequence
atgctgtccgatgagctggagtcgaaaccagagttgcttgtccagtttgtgcagaacaccagcatcccgcttgggcaagggctagttgaaagtgaagccaaagatatcacctgtttgagtttgctgcctgtaactgaggcatccgaatgttccagactcatgctgcccgacgataccacaaaccacagcaattcgtccaaagaagtcccttag

SEQ ID NO: 25258 - DNA, 1437 bp, Artificial Sequence
  Description of Artificial Sequence: Synthetic coding sequence
atgttgtccgatgagctggagtccaagcccgagttactggtccaattcgtgcagaacacaagcattccattggggcagggcttagttgaatcggaagcgaaagacattacttgccttagtctcctgcccgtgactgaagcaagcgagtgtagccggctcatgctccctgacgacaccactaaccattcaaactcatctaaagaggtaccatcaagcgcggttttgcgaagtcttcgagtcaacgtgggccctgatggcgaggagactagagctcagaccgtgcagaaaagtccagagtttctgtcaacaagcgagagcagctctcttctccaggacttgcagccttctgattctacctctttcatcctcctgaacttgactagggccggacttggctcatctgcagagcacctcgtcttcgtgcaggatgaagcggaggactcgggaaatgacttcctctcatccgagagcaccgactcatccatcccatggttcttgcgagtgcaagagttggcacatgattccctcattgcggctacacgggcacagttagccaagaacgccaagacctcctcgaatggggaaaacgtgcacctcggcagcggcgacggtcagagcaaagatagtggtccactgccacaggtggagaagaagttaaagtgcaccgtggaaggatgtgaccggacttttgtgtggcccgcacactttaaataccatttgaaaactcatcgcaacgaccgttccttcatatgtcccgcagaaggatgtggaaagtcattctatgtactgcagagactgaaagtgcatatgcgcacacataacggagagaaaccttttatgtgtcacgaatcaggttgcgggaagcagttcactacggctggtaacctgaagaaccatagaagaatccacacaggtgaaaaaccatttctgtgcgaggctcagggctgcggcaggtcgttcgcggagtactcttctctacggaagcatctggtggtgcattctggcgagaagcctcatcagtgtcaagtgtgtggcaaaaccttctcacagtcaggctcccggaatgtgcacatgcggaagcaccacctccagttgggtgccgctgggtcccaggagcaggaacagaccgctgaacccctgatggggagtagtctgctggaggaagcgtctgtccccagtaagaatttggtgagcatgaattcacagccctctttaggaggcgaaagcctaaacctgcctaacaccaatagcattctgggcgttgacgatgaagtcctcgcagaggggtctcccaggagcctcagctctgtacccgatgttacccatcacttggtgactatgcagtcaggacgccagtcttacgaggtgtctgttctgaccgcggtgaatccccaggagctactaaaccagggtgacctgactgagcgacgcacctag

SEQ ID NO: 25259 - DNA, 225 bp, Artificial Sequence
  Description of Artificial Sequence: Synthetic coding sequence
atgttgagtgacgaactggaatcgaagccagaattactggtccaattcgtccagaacacctcaatccccctcggtcagggtctagtcgaatccgaggctaaggatattacatgcttgtccttgctgcccgtgaccgaggcgtctgagtgttctagactcatgctaccggacgacaccaccaaccacagtaatagctctaaagaggttccctcatctgccgtgtag

SEQ ID NO: 25260 - DNA, 381 bp, Artificial Sequence
  Description of Artificial Sequence: Synthetic coding sequence
atgctcagcgatgaattggagagtaagccagagctgctagtccagtttgtccagaacacgagtatccctcttggacagggattagtggagagcgaggccaaggatattacctgcttatctttgctgcccgttacagaagctagtgagtgcagtcggctgatgttacctgacgacaccacgaaccattctaacagtagcaaagaagtgcccagcagcgcggttctgcgctctctgagggtcaacgtggggccagacggggaggaaaccagagcccagaccgtccaaaaatcccccgaatttctgtccacaagtgagtcctcctctctcctgcaggatctgcagccctcagactcgacaagctttatcttgctgaatctctag

SEQ ID NO: 25261 - DNA, 819 bp, Artificial Sequence
  Description of Artificial Sequence: Synthetic coding sequence
atgctcagtgacgagctcgaaagcaaaccggaactgctagtgcagttcgtacagaacacaagtattcccctgggccaaggtctggtcgagagtgaggcaaaggacattacttgcctttccctgctgcctgtaaccgaggcttctgagtgtagcagactgatgctgcctgatgacaccacaaatcattccaatagctccaaagaagttccatcctcagccgtacttcgcagcctcagggtcaatgtcggaccagacggtgaggagaccagggctcagacagttcagaaatcccccgagtttttatctacgtcagagtctagctcccttctacaagacctccaaccgtccgactcgaccagcttcatattgctcaaccttacgcgggcaggcctgggttctagcgcagagcacctggtcttcgtgcaagacgaagctgaagacagcggcaacgacttcctctcttccgaaagcactgactcctcgataccatggttcctccgcgtgcaagaacttgctcacgatagcctgattgctgccaccagagcacaactggccaagaacgctaaaacctcctctaacggcgaaaacgtgcatctggggtctggcgacggacaatctaaggatagtggccctctgcctcaggtagagaagaaattaaagtgtaccgtggagggttgtgatcggacgtttgtttggcctgcccattttaaataccatctgaagactcatagaagactgtgggaaaagttgctgtgcgccgcagaagccgagggcgcacatgaggatccccagtggcgcgaagccctctatgtgccatag

SEQ ID NO: 25262 - DNA, 939 bp, Artificial Sequence
  Description of Artificial Sequence: Synthetic coding sequence
atggaggagaagccatccggaccaatccccgacatgctggccaccgccgagccatcctcttcagagacagacaaggaagtgcttagccctgctgtgcccgcagccgctccctcttcctctatgtctgaggaacctggcccagaacaggctgccactccacctgtctgggagagggggggagcaggcggtatgcagcagggctctagtcccgcaccggatagctgccagcctggcccaggaccatcacctgggcttaccagtatcgtttccggtacttccgaagatctgcgtccaccaaggcggagaccaccccctggcaagcagattccctgctcaagtcccggatgttgcctttcctttccctccgttagggatctcgcccaacatttgaggacccactgcccgcctactcaaagcctcgaggggaagctgttcagatgctccgcgctcagctgcaccgaaaccttcccctcaatgcaggaactagtagcacacagtaaactgcactacaagcctaatcgttacttcaagtgtgagaattgcttgctgcgattccggacacacagatcactgtttaagcaccttcacgtgtgtgctgagcatgcccagtcacctgctcccccaccacctcccgcactagatagggagcccccagcacccgaacggccacccgaggtggatcctgcatctgccccaggtttgcctttccccttactggaaccattcacgacgccggcacctgcccctactggcccttttctgccatatctcaaccccgcaccgttcggcttaagtccaccacgccttcggccttttctcgccgcagctcctggaccacccgctagttctgccgctgtttggaaaaaaagccagggagctggctcttcacctcggcgtccccagggcggaagcgatgcccctagtggtgcatgtcgctag

SEQ ID NO: 25263 - DNA, 1173 bp, Artificial Sequence
  Description of Artificial Sequence: Synthetic coding sequence
atggaggagaagcctagcggaccaatccctgatatgttggcaactgccgagccatcctcttcagagactgataaggaggtgttgagccccgctgtcccagcggcagctcccagctctagcatgtcagaagagcctggccctgagcaggccgcaacgccaccagtttgggagagaggcggagcaggtggaatgcagcagggctccagtccagctccagacagttgccagccaggacctggaccctcccccggattaaccagtatcgtgtccggtacgtcagaagacctgaggccacccagacgccgaccacccccaggtaagcagatcccgtgttcttcacccggatgttgcctgagtttcccctcagtgagagatctcgcccagcatctgaggacccattgccctcccacacagtcactcgagggaaagctgtttcggtgtagcgccttatcctgcaccgaaacctttccaagcatgcaggagctggtagctcattccaaactgcactataagcccaatcgatatttcaaatgcgagaactgtctgctaaggtttcgcactcatcgatccctatttaaacaccttcacgtgtgtgcggagcacgcgcagtccccggcacctccaccccctcccgctttggatcgtgaaccaccggcacccgaacgcccacctgaagtcgacccagctagtgcacctgggctccccttcccgctacttgaacctttcaccacccccgctcccgctccaacagggccatttcttccatatctcaacccagctccttttggcttgtcgccgcctcgcctgcgaccttttctggccgcagcaccaggccctccggcaagcagcgccgcagtatggaagaaatctcagggcgcaggctctagcccaaggcgaccccaggggggaagcgatgccccttccggacacgcagcaccttcgaggattgtctgggagcacacacggggacggtactcttgcatgcagtgtgctttcagcacagcgtcccgcccagccatgaccctgcacctcgaggaccataggcccggtgccccagctgcccctgccgcaggacctcccaggccagacgcccctgcggatcccgctcctctggctccgaaagtgtccccgctcctgtccgaaggtgaacttcccgttttttcccagctttag

SEQ ID NO: 25264 - DNA, 1785 bp, Artificial Sequence
  Description of Artificial Sequence: Synthetic coding sequence
atggccgctgccgttctcagggatagcacgagtgtgccagtcacagctgaggccaaactcatgggatttacacaaggctgcgtgaccttcgaggatgtggccatctatttttctcaagaggagtggggtctgctggacgaagctcaaagactgctctatcgcgatgtgatgctcgaaaactttgcactgatcacagctctggtgtgctggcatggaatggaggacgaggagacaccggagcagagcgtgtctgtcgaaggagtccctcaggtgagaacaccagaagcttctccctccactcagaagatccaaagttgcgatatgtgcgtaccctttctgactgatatcctgcatctgaccgatttacctggacaggaactttatctgactggtgcctgcgcagttttccaccaggatcagaagcaccacagtgcggagaaacccctggaaagtgatatggataaagcctcgtttgtccagtgttgtctgtttcacgaatccgggatgccattcacctccagcgaggtgggcaaagattttctcgcccctctgggcatactccagcctcaggcaattgccaattacgagaagcctaacaagatatctaagtgcgaggaagctttccacgtaggcattagccactataagtggtcccagtgtcggcgagaaagtagccacaaacacactttctttcatcccagggtgtgcacaggtaaacgcctatacgaatccagcaagtgcggaaaggcttgctgttgtgaatgctccctggtacagctacaacgggttcaccccggagaacgcccatacgagtgcagcgagtgcgggaaatcattttcccagacaagtcatttgaatgatcatcggaggatccataccggggagcgaccatatgtctgtggtcaatgtgggaagtccttttcccagagagccaccttgatcaaacaccaccgcgtgcacacaggggaacgaccatacgagtgtggcgagtgtggcaagtcattcagccagagctccaacctcatcgagcattgtcggattcatacgggtgagcgcccttacgaatgtgatgagtgcggcaaggctttcggtagcaaatctacccttgtaaggcaccagcgcactcacacgggcgagaagccttacgaatgtggggagtgcggaaaactgtttcggcagtcattctccctggttgtgcaccaaagaatccacacgaccgcaaggccatacgaatgtggtcagtgcggtaaaagcttctcacttaaatgcgggctcattcagcaccaactgatccatagtggggctcggccatttgaatgtgacgagtgcggcaagtccttttctcagaggaccactctcaataagcaccataaggtccataccgcagaacgcccttacgtctgcggagaatgtggcaaagctttcatgttcaagtctaaactcgtgcggcatcagcgaacacacaccggcgagagaccttttgagtgctccgagtgtggcaaattcttcagacagagttacaccctggtcgaacatcagaagatacatacggggctgcgtccctacgactgcgggcaatgcggcaaatcatttatccagaaaagttccctcatacagcatcaagtggtgcatacgggtgagcggccatacgagtgcggtaagtgtggaaagtcattcacacagcattctggcctcatcctgcacagaaagtcacacaccgtggagcggcctcgagactcaagcaagtgtgggaaaccatacagcccacggtccaacattgtctag

SEQ ID NO: 25265 - DNA, 1434 bp, Artificial Sequence
  Description of Artificial Sequence: Synthetic coding sequence
atggcagcggctgtgctccgggatagtacttctggctgtgtaacgttcgaggatgttgccatctactttagccaggaggagtgggggcttctggacgaagcccagcgcctcctgtatagagacgttatgcttgagaatttcgccctgatcacagcactagtgtgctggcacggcatggaagacgaggagacccccgaacagtcagtcagtgttgaaggcgtgccccaggtacggacgcctgaggcttccccctccacccagaagattcagtcctgtgacatgtgcgtcccgttcctgacggacattctgcatctcaccgatctgcctggccaagagctttacctgaccggcgcatgcgccgtatttcaccaagaccaaaaacatcactctgcagagaaacccctcgagtcagacatggataaagccagtttcgtccagtgttgcctgtttcatgagagcggcatgccttttacgtcatctgaggtggggaaagatttcttggcccctttgggaatcctgcagcctcaggcgattgcgaactacgaaaaacctaataaaatttcaaagtgcgaagaggcctttcatgtcggaattagtcactacaaatggtctcagtgccgccgagagtcaagccacaaacacacattttttcatccgagggtgtgtaccgggaaaagattgtatgagagctccaagtgcggcaaggcctgctgttgtgaatgctctctggtacagctgcagagagtccaccctggtgaacggccatatgaatgttcagagtgcgggaaatccttcagccagacaagtcatctgaatgatcatcgcagaattcatacaggggaaaggccatattacgagtgtggggaatgtgggaaatccttcagtcagtcgtctaatctgatcgaacactgcagaatccacaccggtgaacgtccctacgagtgcgacgagtgtgggaaggcctttggcagtaagtctaccttggtgcgtcaccagcggacccacacgggggaaaagccatacgaatgcggggagtgcgggaagttgtttagacagtcttttagcctggtcgtgcatcaacggatccacaccactgcgagaccttacgagtgcggacagtgtggtaaaagtttcagcctaaaaagtaaactggtccggcaccaaagaacccatacaggagaacgcccatttgaatgttcggagtgtggtaaattcttccggcagagctatactctggtggaacaccagaaaattcacacaggactgagaccctatgactgtggtcagtgtggcaaatcgttcattcagaaaagtagtttgatccagcatcaggtagtgcacacgggtgagcgtccttatgaatgtggtaaatgcggaaagtcctttacccagcacagcggactgatccttcaccggaaatcccatacagtttag

SEQ ID NO: 25266 - DNA, 1419 bp, Artificial Sequence
  Description of Artificial Sequence: Synthetic coding sequence
atgggttttacgcagggatgcgttacgttcgaggatgtggccatatacttttctcaagaagaatggggattgttggatgaagcgcaacgacttctgtaccgggacgtgatgctggagaatttcgctctcatcaccgccctggtatgctggcacggaatggaggacgaggaaaccccagagcagagcgtttctgtcgaaggggtcccccaggtgagaactcccgaggcttctccttctacgcagaagatccagtcctgtgatatgtgcgtcccattcttaacggatatcctgcacttgacagatcttcctggacaagagctttatctgacaggagcctgcgcagtttttcaccaagaccagaagcatcattctgctgagaaaccactggagagcgacatggacaaagccagtttcgtgcagtgttgcctcttccacgagtctggcatgcctttcacaagctcggaggtgggtaaggatttcctcgcacctcttgggatccttcagcctcaggctatcgcaaattacgaaaagccaaacaagatttctaagtgcgaggaggcctttcatgttggcattagccattacaagtggtctcagtgtcgtcgcgaatcatcccacaagcataccttctttcatcctcgagtctgcacaggtaaacggctctatgaaagttcgaagtgtgggaaagcctgctgctgcgagtgctctttggtgcagttgcagcgcgtgcatcctggagaacgtccatacgagtgctccgaatgcggaaagtccttttcccagacatcgcatttgaatgaccatagaagaatccataccggcgagcgaccttacccatacgaatgcggcgagtgcggcaaactgtttaggcagtccttttctctggtagtgcaccaaagaattcatactaccgccagaccttatgaatgtggtcagtgcgggaaaagcttctccctgaagtgtgggctcattcagcaccaactcatccatagcggcgctagaccatttgagtgtgacgaatgtggcaaatcattctctcagcgcactactctcaacaaacatcacaaagtgcacaccgctgagcgcccatacgtgtgcggagagtgcggcaaggccttcatgtttaaatccaagctagttagacaccagcgtactcacactggagaacgcccattcgaatgctctgagtgcgggaagttcttcagacagagctacaccctagtggaacaccagaagatccacactggacttcgaccttacgattgcgggcagtgtggcaaatctttcatccagaagtcctcgctgattcagcaccaggtcgtgcacacgggcgaaagaccgtatgaatgcggcaagtgcggcaaatcttttacccagcacagcggcctgattttacatcggaagagtcacactgtctag

SEQ ID NO: 25267 - DNA, 1728 bp, Artificial Sequence
  Description of Artificial Sequence: Synthetic coding sequence
atggcagccgcagcgccaagacggccaactcagcagggaactgtgacattcgaggacgtagccgttaactttagccaagaagaatggtgccttctctccgaggcacagcgctgtctctatagagacgtgatgctagagaatttggccttgatctcatcactgggctgctggtgtgggagcaaggatgaggaggcaccatgtaaacaaaggattagcgtccagagggaatcacaatcacgcactccgagggcaggagtttccccaaagaaggcacatccttgcgagatgtgtggcctgatcctggaagatgtgttccatttcgctgaccaccaggagacacaccataagcagaaactcaaccgctcaggtgcttgtggcaagaacctggatgacaccgcctacctgcaccaacaccagaaacaacatattggcgagaagttctataggaagtctgtgcgcgaggcctccttcgtgaaaaaacgcaagctcagggtatcccaggaacctttcgtcttcagagagttcggcaaagatgtcctgcccagcagcggtttgtgccaggaagccgcagcagtggaaaaaacagatagcgaaacaatgcatggtcctcccttccaggagggaaagactaactattcatgcggcaagaggactaaggccttctccaccaagcatagcgtgattccccaccagaagttattcacccgggacggctgctatgtgtgttcggactgtgggaaatcattcagtcgctatgtgtcctttagcaatcaccagcgtgatcataccgccaaagggccttacgattgcggagaatgcggcaagtcttactcccgcaagagctcgctcatacagcatcagcgggtgcataccggcaagaccgcatatccctgcgaagagtgcgggaagtcctttagccagaaaggtagtcttatttcccaccagagggtgcacactggcgagcgcccatatgagtgtcgcgagtatggtaagagttttgggcagaaggggaacctcattcagcatcaacaggggcatactggcgaaagagcataccattgcggagagtgtggcaagtcatttaggcagaagttttgtttcattaaccaccagagagtgcacaccggcgagaggccatataagtgtggcgagtgtggcaaatcttttgggcaaaaaggcaacttggtgcagcaccagcgcggacatacgggtgagcggccttacgaatgcaaggagtgtggcaaaagctttaggtaccggagtcatctgaccgagcaccagagattacacaccggagaacgcccttataactgtagagagtgtgggaagttgtttaaccggaagtatcacctgctcgtgcacgaacgcgtgcatacgggcgagcggccatacgcttgcgaggtatgtggaaaacttttcgggaacaagaattgcgtgacgattcatcagaggatacacacgggtgagcggccttacgaatgcaacgagtgtgggaagtcattcctctctagtagtgccctgcacgtgcacaagagagtgcattccggccaaaagccctacaagtgctccgagtgcggcaaatcttttgctgagtgcagcagcttgatcaagcatagacgaatccacaccggtgaacgaccctacgagtgcacaaaatgcggaaagactttccaacgttcatcaactctcttgcaccaccagagcagtcatcggcgtaaagccctatag

SEQ ID NO: 25268 - DNA, 1131 bp, Artificial Sequence
  Description of Artificial Sequence: Synthetic coding sequence
atgcacggccctccttttcaagagggaaaaactaactacagttgcggcaagaggacaaaagccttttcaaccaaacattctgttatccctcaccagaagcttttcactagagacggctgctatgtctgtagtgattgcggaaagagcttctctaggtacgtaagcttctcaaatcaccaacgcgatcacacagctaaaggaccttatgactgcggagagtgcggcaaaagttacagtaggaaatcctctctgattcagcaccagagggtgcacaccggtaagacggcttacccctgcgaagaatgcggcaagagcttctcccagaagggtagcctgatatctcatcaacgcgtgcatactggcgaaaggccgtatgagtgcagggagtacggtaagagctttggccagaaaggcaatttgatccaacaccagcagggccacacgggagagcgagcctatcattgtggcgagtgtggcaaatcctttagacagaagttttgcttcattaaccatcagcgggtgcacaccggcgagcgcccttataagtgtggggagtgcggcaaaagtttcggtcagaaaggaaacctggtgcagcaccagcgtggacacaccggtgagagaccatacgagtgcaaggagtgtggaaagtctttcagataccgctcgcacctcaccgaacatcaacgtctgcacacgggcgaaaggccctacaactgtagagaatgcggcaagttattcaataggaaataccatctactggtgcatgagcgggtgcatacgggcgagcggccatacgcttgcgaagtgtgcggcaagctcttcggcaacaagaactgtgtgacaatccatcagcgaattcacacaggggagagaccatatgagtgtaacgaatgcggaaagtcattcctcagtagttcagctctgcatgtccataagcgtgtgcattccggccagaaaccctacaagtgcagcgagtgtggaaaatcctttgctgagtgcagcagtttgattaaacacaggaggattcacactggcgagcgtccttatgaatgcactaagtgtggcaaaacattccagaggagttctactctccttcaccatcagagctcacatcgacgcaaagctctgtag

SEQ ID NO: 25269 - DNA, 2031 bp, Artificial Sequence
  Description of Artificial Sequence: Synthetic coding sequence
atgcaaggcaccgtggccttcgaggatgtggctgtgaatttcagtcaggaggagtggtctcttttgtcagaagtccagcgatgtctctatcacgacgtgatgcttgaaaattgggtgctaattagctcactcggttgctggtgtgggagcgaggacgaggaggccccatcaaaaaaaagtatttccattcagcgggtgtctcaggtgtcaacccctggggcaggcgtttcccctaagaaagctcactcctgcgagatgtgtggtgccatcctgggagacatactgcatctggctgaccaccaaggtactcatcataaacagaaactccacaggtgcgaggcatggggcaataagctttatgactcctcaaacaggccccatcagaaccagtatctgggcgagaaaccataccggtcctcagttgaagaggcgctgttcgtcaagaggtgtaagttccacgtgtccgaggaaagctccatttttatccagtctggaaaggattttctgccatcaagtgggctgctgctgcaggaagccacacacactggagaaaaatctaactcaaagcccgagtgcgagtcaccctttcagtggggcgatactcactatagctgcggcgagtgtatgaagcatagctcaacaaaacacgtgttcgtccagcagcaacgtcttccttctagggaagaatgctactgctgggagtgcggcaagagcttctctaagtatgattctgtgtccaaccaccagcgtgtccacacagggaaacgtccctatgagtgtggcgaatgcggaaaatcttttagccacaaaggatcactcgtgcaacaccaaagggtacatactggcaagaggccatatgaatgtggcgagtgcggcaaaagctttagccataaaggttcactggtccagcaccagcgcgtccacaccggggagagaccttacgaatgcggggagtgtggaaagagttttagccagaacggtacgctgatcaagcaccaacgggtgcacacgggcgaaaggccttacgagtgtgaggagtgtgggaaatgtttcacccagaaggggaatctgattcagcatcaaaggggccatacatccgagcgaccatatgagtgtgaggaatgtggcaaatgtttttcgcagaaggggaccctgaccgagcatcatagggtacatacgagggagcgcccttacgaatgcggagagtgtggcaagtctttctctcgaaagggccacctgcgcaaccaccagcgtggacatactggggaacgtccctacgaatgcggggagtgcggaaagtccttctcacgcaagggtaacctgatacagcaccaacggtctcacactggtgagcgcccttacgagtgtagggagtgtcgcaaactgttccgcggtaaatcccatctgatcgagcaccaacgagtgcatacaggcgaaagaccctacgaatgtaacgaatgcggcaaatcattccaggactctagcgggttcagggtccatcagcgggtgcacactggtgaaaagccatttgagtgtagtgagtgtggaaagtccttcccccagtcctgctctctgttacgtcatcgccgtgtgcacacaggcgaacgaccttatgagtgcggagaatgcgggaaatccttccaccaaagctcaagcctcctccggcatcagaaaactcatactgcagagagaccctatgaatgtagagaatgtggcaagttctttagctctcttctggagcacagaagggtccatacaggcgaacggccatacgaatgcagagaatgtggcaagacttttaccaggagatcagctcactttaagcaccagaggctgcacaccaggggcaagccatatgagtgtagcgagtgtgggaaatccttcgcagagacattttcgctgactgagcatcgaagagtgcataccggtgagcgaccatacgaatgctctgagtgcggcaagtctttccacagatcgtcctccttgctgcgtcatcagcgggtgcacactgagcgtagcccttataaatag

SEQ ID NO: 25270 - DNA, 2094 bp, Artificial Sequence
  Description of Artificial Sequence: Synthetic coding sequence
atgcaagagggactgcaccggatgacatgggactgcattgccattgggagtcacgagaattctgtgcagggcaccgtcgccttcgaggatgttgctgtgaatttctcacaggaagagtggtcactcctttccgaggtacagcgatgcttgtaccatgacgtgatgttggaaaattgggtcctcatcagtagcctcggctgctggtgtgggtctgaggatgaagaggcgcctagcaagaagtctatatccatacagcgtgtttcccaggtgagtactcccggtgcaggcgtgtctcccaaaaaggctcactcttgcgagatgtgcggagctatactgggtgatatcttgcatttagctgaccatcagggaacgcatcataagcaaaagctgcaccggtgcgaagcttggggcaataagttgtacgactcgagcaacagaccacaccaaaatcagtaccttggagagaaaccatacaggtcatctgtagaagaggccctgtttgtgaaacgctgtaaatttcacgtcagtgaggagtcatcaatcttcatccagagcggcaaggactttctcccttccagcggtttgctcctgcaagaagctacacacacaggagaaaaaagcaactcaaaacctgaatgtgagtcaccttttcagtggggcgacactcactattcctgtggagagtgcatgaaacactcctctaccaagcatgtgttcgtacagcaacagcggctgcccagccgagaagaatgttactgttgggagtgtggcaagtcgttttccaagtatgacagcgtgtccaatcatcagcgtgtccataccggtaagcggccatacgagtgtggggagtgtgggaagtctttttctcacaaaggatctctggtgcaacatcaaagagtccacacaggtaagagaccatatgaatgcggtgagtgcggcaagtcttttagccataagggcagtctagtgcagcaccagagagtacacacaggtgaaaggccatatgagtgtggcgaatgtggcaaaagcttttcccagaatggcacactcataaagcaccagcgggtccataccggggagagaccatatgagtgcgaggagtgcggaaaatgctttacacaaaaaggaaatctgatacaacatcaacgaggacacacaagcgaacggccttacgagtgtgaggagtgcgggaagtgcttttcccagaaggggacactgacagagcatcacagagtgcatacacgggagcgaccatacgagtgcggcgaatgcggaaagagtttcagcagaaaaggtcatctgagaaatcaccagaggggccacacaggcgaaagaccttatgagtgcggagagtgtggcaaaagtttctctcgaaaggggaacttgatccagcaccagaggagccatacgggcgaaagaccatacgaatgcagggagtgtagaaagttgtttcgaggtaagtcccatctgatcgagcatcagcgcgtacatacaggcgaaagaccttatgagtgcaatgaatgtggaaagtcattccaagactctagcggatttagagtccatcagcgtgtgcatactggggagaaaccttttgagtgctccgagtgtggaaaatctttcccccaatcgtgttctttgctgaggcatagacgagttcacacaggcgagagaccctacgagtgtggcgagtgtgggaagagtttccatcagtcctcatccctgctgagacaccaaaagacacatactgcagagcggccttacgaatgccgggagtgcggcaagttcttttcttccctacttgagcacagaagagttcataccggagagagaccctatgaatgcagagaatgtggcaagacatttacacgacgcagcgcccacttcaagcaccagcgcctgcacacccggggtaagccttatgagtgcagtgagtgtggaaagtcttttgctgagaccttcagcctgactgagcatcggagggtccataccggggagcgcccatacgaatgtagcgagtgcggaaagagttttcatcgttcgtcctctcttctgaggcatcagagagtgcacaccgaacggtcaccatataagtag

SEQ ID NO: 25271 - DNA, 1929 bp, Artificial Sequence
  Description of Artificial Sequence: Synthetic coding sequence
atggctgctgcggctctccgcctgcccgctcaggtcgttggtgtggatcagaagatgagaaggcacttgctgagacgggctttcctatacaaggaatgtcttcgatccgcactcctggggcaggtctcacccaagaaagcccactcctgtgagatgtgcggagcaatcctcggagacattctccatcttgctgaccaccagggaacacatcacaagcaaaaactccatagatgcgaagcatgggggaacaagctgtacgattcaagcaacaggcctcatcagaatcagtatctcggcgaaaagccttacaggtccagtgtcgaagaagccctgtttgtgaagaggtgcaagtttcatgtgtctgaggagagctcgattttcatacagagcgggaaagatttcctgccatcatccggtctgctcctgcaggaagctactcacacaggcgagaagtcaaactcaaaacccgaatgtgaatccccattccaatggggggatacacactacagctgcggggaatgcatgaagcactcatctacaaagcacgtgtttgtgcagcagcagagattgcccagtagggaggagtgctactgttgggagtgtggcaaatccttcagtaagtatgatagcgtgagcaatcatcagagagttcacactggtaaaagaccctacgaatgcggcgagtgcggaaagtccttttcccacaaagggagtctggtacagcatcagcgcgtgcatactggcaaaaggccctacgaatgcggcgagtgtggcaagagtttttctcacaaaggctcactggtgcagcatcaacgcgtccacacaggagaacgcccatacgagtgcggggagtgcggaaaaagtttcagtcaaaacggcactctaattaaacaccagcgagtgcatacaggtgagagaccatatgagtgtgaggaatgcggtaagtgcttcactcaaaaggggaacctgattcagcatcaaagggggcacaccagcgagcgtccatacgagtgtgaagaatgtggtaaatgcttctctcagaagggaacgctgaccgagcaccatagggtgcacacccgagaacggccttacgaatgcggtgaatgcggcaaatccttctctagaaagggacaccttcggaatcatcagaggggtcacaccggggagcgaccctacgaatgcggggaatgtggcaagtccttcagtagaaagggcaacctgatccagcatcagaggtcccacacaggtgagcgcccttatgaatgccgagaatgtcgcaaactgttccgaggtaaatcacatctgattgaacaccagcgagttcacactggcgagcgaccgtatgaatgcaatgagtgtgggaaatcgtttcaggattcctcaggattccgtgttcaccagagagtccatactggggagaagccctttgagtgctccgagtgcggcaagtcgtttcctcagtcttgtagcctgctgagacaccggcgtgtgcacacaggcgagaggccttatgagtgtggcgaatgcgggaagtcgttccatcagagttcgtcactgctgcgccaccagaaaacccatacagcagaacgcccttacgagtgtcgcgagtgtggcaagtttttttcttcccttctggagcacagaagggtgcatactggggaacggccatacgagtgtagagagtgcggcaagaccttcaccagacgttccgctcactttaagcatcagaggctgcacacaagggggaaaccctacgaatgtagcgagtgcgggaaaagctttgcagaaacgtttagcctcactgagcaccgcagggtccacactggagaacgcccttatgagtgttcagagtgcggaaagagctttcacaggagttcctccctactcaggcaccagagggtgcacacagaaaggtccccgtataagtag

SEQ ID NO: 25272 - DNA, 1083 bp, Artificial Sequence
  Description of Artificial Sequence: Synthetic coding sequence
atgcccgaactggtggtgactgccctattggcccctagcaggctcagcctgaaactgttgcgagcattcatgtggagcttagtgttctccgtggccttagtggctgccgctgtttatggctgcattgccctcacccacgttttgtgtcggcctaggcgcggatgttgtggtcgacggagaagcgccagccccgcatgcttaagtgaccccagtcttggggagcacggcttcctgaatctcaagtccagtgggcttcgattgcactatgtgagtgcaggaaggggaaatggcccactaatgttgtttctccatggtttccctgagaattggttcagttggcggtatcagctccgcgagtttcagagcaggttccatgtcgtcgccgtggacctcagaggatacggccctagtgacgcacctcgcgacgttgactgttatacgatagacctattactggtagacattaaggacgtcattctcgggctcggctactcgaaatgtatcttagttgctcatgactggggtgccctattggcctggcatttttcaatctattacccgtctctggtcgagcggatggtggtggtgtcgggagcacccatgtctgtatatcaggactactccctgcatcatattagccagtttttcaggtcccattacatgttcctcttccaattgccgtggctgccagagaagctattatctatgagcgactttcagattctgaaaactacactgacccatcggaagactgggatcccttgtctgaccccctccgagctggaggccttcctctacaacttcagccagcccggagggcttaccggccctctcaattactaccgaaatttattcagaaatttccctttggaaccccaagaactgaccacaccaactttattattgtggggggaaaaagacacatacctggagcttggactcgtcgaagctatcggctcacggttcgttccgggtcggttggaggcacacatcctgccgggtatcgggcattggatccctcagtccaacccccaggagatgcatcagtacatgtgggcttttttacaggatttgttggattag

SEQ ID NO: 25273 - DNA, 1290 bp, Artificial Sequence
  Description of Artificial Sequence: Synthetic coding sequence
gatcctgtacaggggtatgtgacttttgaggatgtcgctgtttacttcagtcaggaggaatggcgcttgttggacgatgcccagcgtctactgtacaggaatgtcatgttggaaaactttaccctgctggccagcctcggcaaacacccagaactcggatcagctttcccacctttccccagagaaaggtctcttgcggtgagcctgatggacctgattcccggtggcctctccgtgcagctcagccaccagtgcgattgttgtctgaccgtgctatttctggtgctgcacgtgtcgcccagtcaccagcagaatccttcagctgtcgcctttaccgagtgcgtcgtagtgggcatggaacgacttctcagtagtaatatccagcagcaccagaagcagcactgtggcgaaaaacctttaaaaagacaagagggtagggtcccagtgctgagaagctgtaaagtgcacttgtctgaaaagagtctccagtctcgtgaggtgggaaaagccctgttaattagctctggtgtgctgaaacatcaggtgacacacacgggggagaagtcccacaggagctctaaaagcagggaagcgtttcatgcaggcaaaagacactacaagtgctcggagtgcggaaaagcgttcggacaaaaatatcttctggtgcagcaccagcgcctccacacaggcgagagaccatacggctgcagtaactgtggcaaatcgttctccagaaacgcccatttaattgaacatcaacgcgtgcatacgggggaaaagcccttcacatgtagcgagtgcggcaaggcattcagacacaattcgactctggtgcaacatcacaaaattcataccggagtgcggccatatgaatgcagcgaatgcggaaagttatttagcttcaacagcagtcttatgaaacatcagagaattcacacgggagagcgaccctataagtgctccgagtgtggtaagttctactcgcataaaagcaatctgatcaagcattggcgagttcataccggagaaagaccttacaagtgcagcgattgcggcaagttttttacacagtgcagtagcttgatgcagcatcagaaggtacatacgggggaaaagccttttaagtgcaacgaatgcggtagattcttccgggagaattccacattggtgcggcaccagagagtgcataccggcgcaaaaccatatgagtgtcgggagtgcgggaaatttttctcccaatctagcacccttatgcaacaccgcaaggttcacatcggcgagaagccttag

SEQ ID NO: 25274 - DNA, 1437 bp, Artificial Sequence
  Description of Artificial Sequence: Synthetic coding sequence
atggcagccgctgccttgagggatccagcacaagtgcctgtggctgccgatctcctgaccgatcatgaggagcaaggctacgtgacttttgaagacgtcgccgtttacttctcccaggaggagtggaggctgcttgacgatgcacagcggcttttatatcgaaacgtgatgcttgagaattttacactgctggcatccctcggttgttggcacggagccgaggcagaagaggcccctgagcagattgcatctgtgggtttattgagctccaatatacaacaacaccaaaagcagcattgcggagaaaaacctttgaagcgccaggaaggaagggtgccagttctccgcagctgtaaagtacacctctctgaaaagagtctccaatctcgagaggttggaaaggccctgcttatttcatccggcgttctcaagcaccaggtaacccacaccggtgagaaatctcataggtctagcaagagcagggaggcgtttcacgctggcaagagacattacaaatgttcagagtgtggtaaagcgtttggacagaaatacctgctggtgcagcaccagcgcctgcatgccggaaagaagacttacgaatgctcagagtgtgggaaactcttcagggatatgtctaacctttttatccaccagatcgtgcacaccggcgaacgaccatacggctgcagcaactgcggaaagagcttttcgcggaatgcacatctcatcgaacaccaacgcgtccatacaggggaaaagcctttcacttgctccgaatgtgggaaggcctttcggcataattccacactcgtccagcaccacaagatccacaccggagtgaggccatatgaatgctctgaatgtggcaaactcttctcttttaactctagtctgatgaagcaccaaagaatacacacaggggaaagaccatataaatgttccgaatgtgggaagttctactctcacaagtctaacctcattaaacattggagggtccatactggggagaggccatataaatgtagcgattgtggcaaattctttacccagtgttcttccttgatgcagcaccagaaagtccacacgggggagaagccctttaagtgcaacgagtgcggtaggttcttccgggaaaacagcacactcgtccgacaccagcgcgtacacaccggcgcaaagccatatgagtgccgagaatgcggcaagtttttttctcagagctccaccctcatgcagcatagaaaggtgcacataggcgaaaaacctttcaaatgcaatgagtgcggtcgattgttcagagagaacagcagcctcgtgaagcaccagcgcgtacacaccggcgcaaaaccgtatgagtgtcgggagtgcggaaagttctttaggcacaattcaagccttttcaaacaccgtagaatccatacgggagaaatgcagtag

SEQ ID NO: 25275 - DNA, 1329 bp, Artificial Sequence
  Description of Artificial Sequence: Synthetic coding sequence
atggcggctgctgccctccgggacccagcccagcaggggtacgtaaccttcgaggatgtcgctgtatatttttcacaggaagaatggcgactgcttgacgatgctcaacgtctcctgtaccggaacgtcatgctggaaaacttcaccttgctggccagcctcgggctggcatcatctaagacccatgaaatcacacaactcgaaagttgggaggagccattcatgcccgcttgggaggtggtcacgtctgcaatccctcgagggtgttggcatggggctgaggctgaggaagcccctgaacaaatcgctagtgttggtttgctcagtagcaacatccagcagcatcaaaagcagcactgcggcgaaaaacccttgaaacgacaggagggcagagttcccgttcttcgctcttgtaaagtgcacctctctgaaaagtctctgcagtctagagaggtggggaaggccttgctgattagcagcggtgtcctgaaacatcaggtcacccacacaggagagaagtcacaccgaagctcaaagtcacgcgaagcgttccacgcgggaaaacgtcattacaagtgcagtgaatgcggcaaagccttcgggcagaaatacctacttgtgcaacatcagagattacatgctgggaagaaaacatacgagtgttcagagtgcggaaaactgttcagggacatgtctaacttgttcatccaccagatcgtgcacactggcgagcgcccatacggttgctctaactgcggtaagagtttcagtaggaacgcccacctgatagaacaccaaagagtgcacacaggagagaaaccattcacatgcagtgagtgtggaaaagcttttagacacaactctacgttagtacaacaccataaaatacatactggcgtacgcccttatgagtgttccgagtgcggtaagcttttttcctttaactcatccctgatgaaacatcagcgaatccacactggtgagagaccttataagtgctccgagtgcggcaagttctattcacacaaatcaaacctcattaagcactggagagtgcatacgggcgaaaggccttacaaatgctccgattgcgggaaatttttcactcagtgttctagcctaatgcaacaccagaaggtgcatacaggcgagaagccttttaagtgtaatgagtgcggccgattcttccgagagaacagttctctcgtgaaacaccagcgcgtgcacactggcgcaaaaccatacgaatgtcgcgaatgcggcaagttttttcgccacaattcctcacttttcaaacaccggagaatccataccggcgaaatgcagtag

SEQ ID NO: 25276 - DNA, 1395 bp, Artificial Sequence
  Description of Artificial Sequence: Synthetic coding sequence
atggccgctgcggctctgagagaccccgctcaagggtatgttacgttcgaggatgtggcagtctacttctcacaggaagaatggagattgcttgatgatgcgcagcggctgctgtaccgaaacgtaatgctggaaaattttactctgctggctagcctgggttgttggcacggagctgaagccgaagaagcaccggagcagattgcctccgtggggttgctaagctctaatattcagcagcaccagaaacagcattgcggcgagaaacctttaaagcgacaggagggcagggtgccagttctcagatcatgtaaggtgcacttatctgaaaagagcctgcagagccgagaggttggcaaagccctgctgatcagctcgggcgtcctaaaacaccaagtgacacacacaggtgagaaaagccatcgtagctcgaagtcccgggaagcttttcacgcaggaaagcgtcattacaagtgctctgagtgcgggaaagcctttggtcaaaagtacctgctcgttcagcaccagcgtctccacgccggaaagaaaacctatgagtgcagtgagtgtgggaagttatttagggacatgagtaatctgttcatccaccaaatcgtgcatactggggagcgaccctatggctgtagtaactgcgggaagtccttctcaaggaacgcgcacttgatagagcatcagagggtgcacaccggcgagaaacctttcacttgcagcgaatgcggaaaggctttcagacataactccacactggttcaacatcacaagatccacaccggagttcgcccttatgagtgctctgaatgcggaaaactgttttcctttaactcttcactcatgaaacaccaaagaattcatactggcgagaggccttataaatgtagcgagtgtgggaagttctactcacataagtcaaatcttatcaagcactggagggtacacaccggcgagcgtccctacaagtgttccgattgtgggaaattctttactcaatgtagctctctgatgcaacaccaaaaggtgcacacaggtgagaaaccattcaaatgtaacgagtgcggcagattcttccgggagaattcaactctggtcagacaccagcgcgtgcacaccggggctaaaccttacgagtgtagagagtgcggcaaattcttttcccagagctcaacattgatgcagcatagaaaagtacacatcggagagaaaccattcaagtgtaacgagtgtggcaggctttttcgggagaactcaagcctcgtgaagcatcaaagagtgcacacgggggctaagccctacgagtgccgcgagtgtggaaagttcttccgacataattcatccctttttaagcatagaaggatccacacgggggagatgcagtag

SEQ ID NO: 25277 - DNA, 1536 bp, Artificial Sequence
  Description of Artificial Sequence: Synthetic coding sequence
atggcagctgcggctctccgggatccagcccaggtcccagtggccgctgatctactcactgaccatgaagaacagggatatgtgacatttgaggatgttgccgtgtacttcagtcaggaggaatggaggcttcttgatgatgcccaacgtctcctgtacaggaacgttatgctggagaacttcaccctgttggcgagccttgggctcgccagcagcaagactcatgaaataactcagctcgaatcttgggaggaaccctttatgcccgcatgggaagtggtgacaagcgccatcccacgagggtgttggcatggtgcggaagctgaagaagcccctgagcagatcgcaagcgtcggccttttgagctccaatatccagcagcaccaaaagcagcactgcggtgaaaagcccctaaagcggcaagagggacgagtgcctgtgttgcgcagctgtaaagtccacttgtccgagaagtctctgcagagcagagaagttgggaaagcactgttaattagttcaggggtcctcaagcatcaggtcacgcacacaggtgagaaatcacatagaagctcaaagagcagggaggcctttcacgcaggcaagagacactataagtgtagcgagtgcggaaaggccttcggccagaagtatctgctcgttcagcatcagcggctgcacgctggcaagaagacctacgagtgctcagaatgcggcaagctgttcagagatatgtccaatctgtttatacatcagattgtgcatactggagagcggccatacgggtgctcaaactgcgggaagagcttttcacgcaatgcgcatctgattgaacaccagcgggtccacacaggagaaaaaccattcacgtgctcagaatgcggaaaggcttttaggcataatagcacacttgtgcagcatcacaagatccatacaggcgtgcggccatatgagtgctccgagtgcgggaagcttttttcatttaactcttctcttatgaagcaccagcgaatacataccggtgagagaccgtataagtgtagtgagtgtggaaagttctactcccacaaatctaatctgatcaaacattggagagtgcatactggcgaacggccatacaagtgtagtgattgcgggaagtttttcacacagtgctcctcgctcatgcagcatcagaaggtgcacaccggagagaaaccctttaaatgcaatgagtgcggccgattctttcgtgagaacagtaccctggtcaggcaccaaagggtgcataccggcgctaaaccatacgagtgtagggagtgcggaaagttcttctctcagtcatccacactaatgcagcatagaaaagtacacatcggggagaaaccgttcaagtgtaatgaatgcggaagactgtttcgagagaattcaagtctagtcaaacatcagcgtgtccacacaggtgctaaaccttacgaatgccgagaatgtgggaagttctttagacacaactcctcactgttcaagcatcggaggatccacaccggggaaatgcagtag

SEQ ID NO: 25278 - DNA, 1497 bp, Artificial Sequence
  Description of Artificial Sequence: Synthetic coding sequence
atggcagctgccgctctccgggaccccgcacaacaagggtacgttacctttgaggacgttgcggtgtactttagccaggaggaatggagactacttgatgacgcccagagactcttgtatagaaatgtgatgctggaaaactttacacttctggcctctctgggcctggcgtctagcaagacacacgagattacccagcttgaatcgtgggaggagcctttcatgccagcctgggaggttgtgacctccgctattcccaggggatgttggcatggtgccgaagccgaagaagccccagagcagatagcaagcgtgggcctcctgagtagtaatatccagcagcaccaaaaacagcactgcggggagaagccactgaaacgtcaggaaggccgagtccctgtactgagatcctgcaaggtgcatctctctgagaagtcacttcaatctcgagaagttggcaaggctctcctgatatccagcggcgtcctgaaacaccaggtgacgcacacaggtgaaaagagccatcggtcatccaaatcgcgggaggcatttcacgccggtaagagacattacaagtgctcagagtgcggcaaggcctttggacagaaatatctcctggtacaacaccaacgcctgcacgccggtaaaaagacatacgaatgttccgagtgcggaaaactgttcagagatatgagtaacctattcatccatcaaatagtgcacacaggagagaggccttatggttgcagcaattgtgggaaatctttttcccggaacgcgcatttgatcgagcatcagcgcgtgcatactggtgagaaaccattcacctgctctgaatgtgggaaggcgtttcggcataacagtaccctggtgcagcatcacaaaatccacactggagtgaggccgtatgagtgctctgaatgtgggaagctattcagctttaactcgtcccttatgaaacatcaaagaattcataccggagaaaggccatacaaatgttccgagtgcgggaagttctacagccacaagtccaatctcattaaacactggcgagtacataccggtgagcggccttataaatgctcagattgtggaaagttttttactcaatgttcctctctcatgcaacatcagaaggtgcatactggcgaaaagccctttaaatgcaacgaatgcggaagattttttcgggagaactccaccttagtgagacatcagcgggttcataccggcgctaaaccatacgaatgtcgcgagtgtggcaagttcttttcacaatcatccaccctgatgcagcacaggaaagtgcacatcggagagaaaccattcaaatgcaatgagtgtggtagattgttccgggagaattctagccttgtgaagcaccagagggtccatactggagccaagccatacgagtgtcgtgagtgtggtaagttttttcgacacaactccagccttttcaagcaccggcgtatccacactggagaaatgcagtag

SEQ ID NO: 25279 - DNA, 477 bp, Artificial Sequence
  Description of Artificial Sequence: Synthetic coding sequence
atggccgctgccgcactgcgagatccggcacaggtacccgttgccgctgacttgttaactgaccatgaggagggctacgtcacattcgaggacgttgctgtttacttcagccaagaggagtggcggctgctggatgacgcccagcggttactctatagaaatgtgatgctggagaattttaccctgttagcaagcctgggttgttggcacggtgcagaggccgaggaagctccagagcagatcgcatccgttggcctccttgaggtgcttgccaagcagggagggtgctccggcaagaaaacttacgagtgctcagagtgcggcaagcttttcagggatatgtcaaacctgtttatccatcagatagtccacaccggcgaacgtccatatggatgttctaactgcggtaagagcttcagccgcaatgcccatctcatcgagcatcaacgtgtgcacacaggagaaaaaccattctag

SEQ ID NO: 25280 - DNA, 1494 bp, Artificial Sequence
  Description of Artificial Sequence: Synthetic coding sequence
atggcagccgctgccctacgggacccagcccaggggtacgtaacgtttgaagatgttgcagtgtacttcagtcaggaggaatggcgcctgctcgacgacgcccagagactcctttaccgcaacgtgatgttggaaaattttacgctacttgcttcactgggcctggccagctccaaaacccatgaaattactcagctagagtcttgggaggaaccatttatgcccgcatgggaagttgtgacatccgcaatccccagaggctgttggcacggtgccgaggccgaagaggcaccagagcagatcgcctctgttgggttgctgtcgtctaacattcagcagcaccagaagcagcactgcggagagaagcctttgaagcgccaggaagggagagtgccagtccttaggtcctgcaaagtgcatctctcagagaaatctcttcagtctagggaggtgggcaaggcactgctgatcagttcaggcgtgctcaaacatcaagttacccacactggcgagaagagccaccgcagcagcaaatctcgtgaagccttccacgccggaaagcggcactataagtgctccgagtgtggtaaagctttcggccagaaatacctgctggtgcagcaccagcggctgcacgcgggaaagaagacgtacgaatgctcggaatgcggcaagctgttccgcgatatgagcaacttgttcatacaccagatcgttcacaccggagaacgcccatacgggtgctccaattgcggtaagagtttctctagaaacgcacatttgattgaacaccagagagtgcataccggcgaaaagccatttacttgctccgagtgcgggaaagcctttcgccacaactccactcttgttcagcaccataagatccacactggcgtacgcccatatgaatgcagtgaatgcggtaagttattcagcttcaactccagcctgatgaagcaccagaggattcacaccggagagagaccgtataagtgcagcgaatgcggaaaattttatagccataagagcaacttaataaagcactggcgggtacacaccggtgagcgaccttacaagtgcagcgattgcggtaagttcttcacccaatgttctagcctaatgcagcaccagaaagtgcacaccggcgaaaaacctttcaagtgcaatgaatgtggcagattctttcgcgagaatagtactctggttaggcatcagagagttcacaccggagccaaaccttatgagtgcagggaatgtggaaagttcttctcccagagctccactctcatgcagcaccgcaaagtgcacattggggagaaaccttttaagtgtaacgaatgcggcagactgtttagagaaaactcctccttagtgaagcaccagagggtgcacaccggggctaagccatacgagtgtcgcgaatgcgggaaattcttccggcacaactcctccctttttaaacataggcgaattcacactggggaaatgcagtag

SEQ ID NO: 25281 - DNA, 1335 bp, Artificial Sequence
  Description of Artificial Sequence: Synthetic coding sequence
atggctgcagccgcactaagggatccggctcaagtgcctgttgcagcggacctgctaactgatcacgaggagcagggatacgttacatttgaggacgtagctgtgtatttctctcaggaagaatggagactcctcgatgatgctcaacggctgctctacagaaatgtgatgctcgagaattttacactgttggcgtcgctggggctagccagttctaagactcatgagatcacacaactcgagtcttgggaggagcccttcatgcccgcttgggaggtagtgacgagtgccattcccaggggttgttggcatggcgcagaagccgaagaggcaccagaacagatcgcctctgttggccttttgtcctccaacattcaacaacaccagaagcagcactgtggggagaaacccctgaagcgccaggagggaagagtgcccgtgctccgatcgtgcaaagtccacttgtcagagaagagtctccagagtcgagaggtgggcaaggccttactgatcagttcgggagtccttaagcaccaggtgacccatacaggcgagaagagtcacaggagcagtaaaagcagagaggcttttcatgccggaaagaggcactacaagtgttctgagtgtgggaaagctttcgggcagaagtatctgctggtccagcaccagcgattacacgcagggaaaaaaacatacgaatgtagtgaatgcggaaagctgtttagagacatgtccaatctgttcatccatcagattgtccataccggtgagaggccatatggctgctcaaactgcggtaagtcattttcacgcaatgcacatctgatcgaacatcagcgagttcatactggcgagaaacctttcacatgttctgagtgtggaaaagccttcagacataactctaccctggtccagcaccacaaaatccacacgggcgtccggccttatgaatgttcggagtgtgggaagctattctcctttaattcttctctgatgaaacaccagcgcatccatactggagagaggccatacaaatgttccgaatgcgggaagttctacagtcacaaatcaaatcttatcaagcactggagagttcacacgggagaacggccttataaatgcagtgactgcggcaagtttttcacccagtgttcatccttgatgcagcaccaaaaagtgcataccggcgaaaaacccttcaagtgcaatgagtgtgggaggtttttccgggagaattcgaccctcgtgagacatcagagagttcataccggcgcaaaaccttacgaatgcagagaatgcggtaagttcttttctcagtcatccactttgatgtag

SEQ ID NO: 25282 - DNA, 366 bp, Artificial Sequence
  Description of Artificial Sequence: Synthetic coding sequence
atggctgctgccgcacttcgcgacccagcgcagcagggctatgttacctttgaggacgttgctgtctatttcagtcaggaagaatggcgcctgctggatgatgcccagcggctcctgtaccggaacgttatgctagaaaacttcactcttttggcgagcctaggatgctggcatggtgcagaagctgaggaggctccagagcagattgcttcggttggccttctctcctcaaatatccaacagcaccaaaagcaacactgtggagagaagcctctcaaacggcaggagggtcgagtgcccgtgctcaggagctgtaaagtacatttgtctgaaaagtcactgcaaagtagagaagtggggaagtag

SEQ ID NO: 25283 - DNA, 408 bp, Artificial Sequence
  Description of Artificial Sequence: Synthetic coding sequence
atggctgccgcagcactccgagatcccgcacagcaaggatatgtgacctttgaggatgtggccgtttatttcagccaggaggagtggcgcctcttggacgacgcacagcggctgttatatcgtaatgtgatgctggagaacttcaccttattggcaagcctgggactggcctcatccaaaacccacgagattactcagcttgaatcatgggaggaaccctttatgccggcatgggaggtcgtgacttcagccatccccaggggctgttggcacggcgcagaggctgaggaagccccagagcagatcgcgtctgtgggcctgctctcatcaaatatccagcaacatcagaagcagcactgcggcgagaaacccttgaaaaggcaggaaggcagggtgcccgtcctctag

SEQ ID NO: 25284 - DNA, 1611 bp, Artificial Sequence
  Description of Artificial Sequence: Synthetic coding sequence
atggctcggaagctggtgatgttcagggacgtggccattgatttttcccaggaagagtgggaatgcctggatagtgcccagcgtgatttgtatagagacgtgatgctggaaaattactctaatctagtgtctctggacctgccaagccgctgcgcctctaaggacctctcaccagagaagaatacttacgagacagaattgtcccagtgggaaatgtcagatagactcgaaaattgcgacctggaggaatccaatagtagggactatctggaggccaaaggaaagatggagaagcagcaagagaatcagaaagagtattttaggcaggggatgatcatctacgacaaaatgtcaatcttcaaccagcacacctacctctcgcaacattccagatgtcatagtacagagaagccctataaatgcaaagaatgtggcaaggcctttcgcagggcatctcatttgacccagcatcagtcaattcatacgggcgaaaaaccctatgaatgtaagcagtgtggtaaggccttcagtcgtgattcgcagctcagcctccaccagaggctgcacacaggggaaaaaccttacgcatgcaaagaatgcggaaaggctttcacacagtctagtcagttgattcttcaccacaggatccacaccggtgaaaagccgtacaaatgtgaagagtgcgggaaagccttcatccgctcctctcaactaactcgccaccagaaagtgcataccggcgagaaaccctatgagtgcaaggagtgcgggaaagcttttacacaaaattcccaattaacgctccaccagcgcctgcacactggagaaaagctttacgagtgcaaggaatgtcgtaaagtattcactcagctgtcccagctgatcctacacaagcgcatccacaccggtgagaaaccctacgagtgcaaagaatgtgggaaggcattcatatgtgggtctcagttgagccaacatcaaaagatccataatggcgaaaagccgtacgaatgcaaagaatgtgggagagccttcattcgaggctctttgttaatgcagcatcagaggattcacaccggcgaaaagccttacaagtgtgaggagtgcggtaaagcttttattagaggctcgcagctgacccaacatcagcggattcatacgaatgagaagccatatgaatgtaaggagtgcgggaaaatgtttagccacgggtctcagctaacccaacatcagaggattcacaccggtgaaaagccttatcaatgtaaagagtgcggcaaagctttcaacaggggctccttgctgacacgtcaccagcggattcacactggtgagaaaccatatgaatgcaaagaatgtggaaagacattttcccgtggtagtgagctgacacaacacgagcgaattcatactgcttttctcgcagggcaacaagatcgctccgatatctacatgtcaagacggttcactaagtcaatattccccgtgttcttctccgtcccaacgatgtggacttcaaaactggagctgaggtattcacatggagactttgagaatggcatttgggtcctgtggataatggagcagaagtataggcgctctctgcagccctag

SEQ ID NO: 25285 - DNA, 2067 bp, Artificial Sequence
  Description of Artificial Sequence: Synthetic coding sequence
atggcaagaaaattagtgatgttccgtgatgtggccatcgactttagtcaagaggagtgggaatgcctggacagcgcacaaagggacctgtaccgagatgttatgctcgaaaactattcaaaccttgtaagcctggacctgccatctcgatgtgcatctaaggatctaagccctgagaaaaacacttacgagactgagttgtctcagtgggagatgagcgaccgcctggaaaactgtgatctcgaggagagtaattctagagactatcttgaggcaaaaggcaagatggaaaagcagcaggagaaccagaaagaatatttccgacaaggcatgattatctacgacaaaatgagtatctttaatcagcacacatatctgagccaacatagtagatgtcactctactgagaagccctataaatgtaaggagtgtgggaaagcatttcgcagggccagccatttgacacagcaccagagcattcacaccggcgaaaagccgtacgaatgtaaacaatgtggcaaggctttctctcgcgattcacagttatcgctgcaccagcgtctgcatactggggaaaagccttatgcttgtaaggagtgcgggaaggcattcacccagagttctcaacttatcctgcaccatcgcatccacactggagagaagccttacaaatgcgaggagtgtggcaaggcctttattcggtccagtcagctaacacgccatcagaaagtccataccggagaaaagccatatgaatgcaaggaatgcgggaaagccttcacgcaaaattctcagctgaccctgcatcagaggctgcatacaggcgaaaaactatatgagtgcaaagaatgcaggaaggtgttcacccagctgtcacagcttatcctccacaaacgcatccatactggcgagaaaccttatgagtgtaaggagtgtgggaaagcttttatctgtggcagtcagctatctcaacaccagaaaatccacaatggagagaagccttacgagtgtaaggagtgcggcagggcctttatccgcggaagcctgctgatgcagcatcaacggatacataccggtgagaagccctacaaatgtgaggagtgcggcaaggcctttattaggggctcacaattaacacagcatcaaaggattcacactaacgaaaaaccctacgagtgcaaagaatgcgggaagatgttcagtcacggctcacagctgacccagcatcagcggatccacacaggagagaagccatatcaatgcaaggagtgcggcaaagcatttaaccgcggatccctgctcactcggcaccagagaatccacaccggtgagaagccatatgaatgtaaagaatgcgggaaaacgttctcccggggatcagagctcacacaacatgagcgaatccacaccggcgaaaagccttacgaatgcaaggagtgcggcaagtcattcattcggggatcgcaactcactcagcatcaaaggattcacactggagagaaaccatatgaatgcaaggaatgccgcatggctttcacccagagcagccatctgagccagcatcagaggctgcacacgggagagaagccgtacgtgtgcaacgaatgcggtaaggctttcgccaggggtctgctgctgattcagcaccagaggattcacacgggagagaagccctatcaatgcaaggaatgtggcaaggccttcattcggggaagccagctgactcagcatcagcgcattcacaccggcgagaagccctacgaatgtaaggaatgcggtaaggccttttctcatggatctcaactcaccctacaccagcgcattcacacaggcgagaagccgtatgaatgtcgcgagtgtcgcaaggcctttacccagagctctcatttgtcaaggcatcagagaatccacactggcgaaaagccctaccaatgtaaagaatgcgggaaggcgttcacaagaggttctcagttaactcaacatcaaaggattcatatcagcgaaaaatcctttgagtacaaggagtgtggaattgatttctcgcatgggtcacaagtgtatatgtag

SEQ ID NO: 25286 - DNA, 1665 bp, Artificial Sequence
  Description of Artificial Sequence: Synthetic coding sequence
atggccgcagcagatttaagtcacggacattacctctcaggagatcctgtctgtcttcacgaggaaaaaacgccagcaggaaggattgtcgctgattgcttgaccgactgttatcaagatagcgtgactttcgatgatgtggcggtagatttcacccaggaggagtggaccctgcttgactctacgcaaagatccctgtactctgacgtaatgcttgagaactacaaaaatctagccactgttggtggacaaattatcaagccttctctcatctcttggctggagcaggaagaaagcagaacagtgcaaggaggcgtcctccaggggtgggagatgagactggagacacagtggtctatcctgcagcaggacttcctgcggggacagacttctattggaattcagttagaaggtaaacacaatggacgagaactgtgcgattgtgagcagtgcggggaagtattttctgagcacagttgtcttaaaacacacgtaagaacacagtcaactgggaacacgcacgactgtaaccagtatggcaaggacttcctgactctttgcgagaagacctccaccggcgaaaagctgagcgaattcaaccagagtgagaaaattttttccttgacccccaacatcgtgtaccagcggaccagtacacaggaaaaatcctttgaatgctcccattgtggaaagagcttcattaatgaatcctatctgcaggcccacatgcgcacccataacggcgaaaagctgtatgagtggcggaattatggtccgggatttatcgattccacgagcttatcagtcctgatcgagacactaaacgctaaaaaaccttacaaatgtaaagaatgtgggaagggatacagatatccagcctatttgagtatccacatgcggacgcacacaggggagaaaccctatgaatgtaaggagtgcggcaaagcatttaactacagtaacagttttcagatccacgggaggacccacacaggcgagaagccgtacgtgtgcaaagagtgtgggaaggccttcacgcaatacagcggcttgagcatgcatgttaggtctcactcaggcgacaagccctatgagtgtaaagaatgcggaaagtcgtttttgaccagcagtagactgatccaacacatccggactcacacaggcgagaagcccttcgtatgtgttgagtgcggtaaggccttcgcagtgtcaagtaacctgtcaggccacctgagaacgcatacagaagagaaggcttgcgaatgtaagatctgtggaaaggttttcggatatccatcttgcctgaataatcatatgcgcactcatagtgcacagaaaccttacacctgcaaagagtgtgggaaggcctttaattactccacgcacttgaagattcacatgcgcatccacaccggtgaaaagccctacgagtgcaagcagtgtggtaaggctttttcgcacagttccagtttccagatccacgagcgtactcacactggggagaagccatatgagtgtaaagagtgtggaaaggcctttacttgttcaagctcgtttagaatccacgaaaaaacccatacagaagagaagccgtacaagtgtcaacaatgcgggaaagcgtattctcacccgagaagcctgaggcggcacgagcagatccactag

SEQ ID NO: 25287 - DNA, 1665 bp, Artificial Sequence
  Description of Artificial Sequence: Synthetic coding sequence
atggctgcagctgatttgagtcacggacattatctgtctggcgaccctgtatgtctgcacgaggaaaaaacccctgcaggaaggattgttgctgattgcctgactgactgctaccaggactcggtgaccttcgatgacgtcgcagtggacttcacccaggaagaatggacccttttagactctacacagcgttccctgtattctgacgtgatgctggagaactacaagaacctcgctaccgtgggtggtcaaattatcaagccatcccttatctcttggctggaacaggaggagagcagaacagttcagggaggagtattgcagggctgggagatgagattggagacccagtggtctatactgcaacaggactttctgaggggccagacttctatcggtatacagctggaaggaaaacataatggtagagaactctgtgattgcgagcaatgtggagaggtattcagcgagcactcttgtctgaagacacacgtccggacgcaatctacgggaaacacccatgattgcaatcagtacgggaaggattttcttacactctgcgagaagactagcacaggcgaaaagctcagtgagtttaatcagagcgagaaaatcttttcacttacacctaatatcgtgtaccagcggacctccactcaagaaaagtcttttgagtgttcccattgcggcaaatcatttatcaatgagtcatacctccaggcgcatatgaggacacacaatggcgagaagctgtacgagtggaggaactatgggccaggcttcatcgattcaacgtcgttgtccgtgctcattgaaaccctgaacgcgaaaaaaccttacaagtgtaaagagtgcggcaaaggatacagatatcccgcttacctcagcatccacatgagaactcatacaggagaaaagccgtacgaatgcaaggagtgcggaaaggccttcaattatagtaactccttccagatccatgggcgtacccatacgggagagaaaccgtatgtgtgcaaagaatgcgggaaggcctttacccagtactcaggtctatctatgcacgtgcgctcccactccggcgacaagccctatgagtgcaaggagtgcggcaagtcttttctaacatcttccagactgattcaacatatccggacccacaccggagagaagccctttgtgtgtgtggagtgcggcaaggccttcgcggtgtccagcaacttatctggacacttgcggactcacaccgaagagaaagcctgtgagtgcaagatttgtggcaaagtcttcggctacccgagctgcctcaataaccatatgcgtacacattccgcccaaaaaccctacacatgtaaagagtgtggcaaggcttttaattatagcacccatttaaagattcacatgaggatacatactggtgaaaagccctacgagtgcaaacaatgtggaaaggccttcagtcattcgtcctcgttccagatccatgaacgcacccacaccggcgaaaaaccctacgagtgcaaggaatgtggaaaggcattcacgtgtagttcaagcttcagaattcacgagaaaactcacaccgaagagaagccttataagtgccagcagtgtggaaaggcctacagccacccaaggtccttgaggagacatgaacaaatccactag

SEQ ID NO: 25288 - DNA, 1626 bp, Artificial Sequence
  Description of Artificial Sequence: Synthetic coding sequence
agcgatggagacataaatgaaaggagggtcctcaccaggtcccaccttgccggatggcagctcctgatttgccctatggattccgtcacatttgacgatgtagcggtggactttacgcaggaggagtggactctgctggactctacccaaagatctctgtatagtgacgtgatgttagagaattacaagaacctggcaactgttggcggacagataatcaagccctctctcattagctggttagagcaggaagaatccagaactgttcaagggggagtgcttcagggatgggaaatgagactcgagacacaatggtccatcctccaacaagatttcctccgaggccagactagtattggcatccagcttgagggcaaacacaatggcagagaattgtgcgattgcgaacagtgtggggaggtgtttagtgagcactcatgcctaaagacacatgtcaggacacagtccacaggcaacactcacgattgcaaccaatatggcaaggatttcctgaccttgtgcgagaagacaagtacgggtgagaaactctccgaatttaatcaatcagagaagatttttagtctgacccccaatattgtgtaccagaggacatcaacacaggagaaatccttcgagtgctcacactgtggcaagagtttcatcaacgagagttacttacaggctcatatgagaacccacaatggtgaaaaactatacgagtggaggaattatggccctgggtttattgactcgacaagtttgagcgtgttgatcgagacacttaatgcgaaaaaaccatataaatgtaaggagtgcggcaaagggtaccgctacccggcttacctcagcatacatatgaggacccacacaggtgaaaagccttatgagtgtaaggaatgtgggaaggcatttaattactctaacagctttcaaatccatggcagaacacacactggcgaaaaaccatatgtgtgtaaggagtgcggcaaggcattcactcagtacagtgggctcagcatgcacgtgagatctcatagcggggataagccctacgagtgtaaggagtgtggaaagtccttcttgacgtcaagtcgtctcatccaacatatccgcacacacaccggagaaaaaccctttgtctgcgtagagtgtggtaaagcttttgcagtgtcatccaatctatcagggcatctgagaacacacaccgaggaaaaagcctgtgaatgtaagatctgcggtaaggtctttggttaccccagctgtctcaataatcatatgcggacgcactcagcacaaaaaccctatacttgcaaagagtgcggaaaagcattcaactattcaacacatttgaagatccacatgagaatccacaccggtgaaaagccatacgagtgtaagcaatgtggcaaggcattcagccacagcagttctttccaaatccacgagaggacacatactggcgagaagccgtacgagtgtaaggaatgcgggaaggcctttacctgttcctctagcttcagaatacacgagaaaacccatacagaagaaaagccctacaaatgccagcagtgtgggaaggcatacagccatccacggtcattaagaagacatgagcagatccactag

SEQ ID NO: 25289 - DNA, 2025 bp, Artificial Sequence
  Description of Artificial Sequence: Synthetic coding sequence
atggggcctttgacgttcacagacgtggccatagagttttccctagaggagtggcagtgtttggacaccgcgcagcagaacctgtaccggaatgtgatgttagagaactacaggaatttagtgttcttaggcatcgccgtgtcgaagcccgaccttatcacttgcctggaaaaggaaaaggagccctgtaaaatgaagagacatgagatggtcgatgaacctcctgtggtgtgtagtcatttcgccgaggatttttggccagagcaggacattaaggatagtttccagaaagtaactcttcggcgttatgacaaaagaggccacgagaatttgcagctacgaaaaggctacaagaccgtgggtgattgcaaactctataagggcggatacaacggcctaaaccaatgcctgaccctgactcagagcaaaatgtaccactgtgacatctacgtgaaagttttctatgcattcagcaatgctgaccgctacaagaccaggcacactggaaaaaagcctttccaatgcaaaaagtgtggaaagtctttctgtatgttgtcccaactcacacagcataagaagattcatatcagagagaacacctacagatgtaaggagtttggtaatgctttcaatcagtctagcgcgttgaccaaccacaagaggatctatgtgggtgaaaagcactaccgttgcgaagagtgtggcaaagcctttaaccactactctactcttaccaatcacaaacggatccatactggtgagaaaccctacaagtgtaaggaatgtggcaaggcttttagcagatattcaacacttaccactcacaaaagaatacactctggtgagaaaccctataagtgtgatgagtgcggtaaaaccttctctatatctagcacttttaccaaacacaagattatccacacagaagaaaaaccgtacaagtgcaaagagtgcggcaaggccttcaaccggtcctccacactgacgagccacaaaaggatacatacaggtgaaaaaccttacaaatgcgaggaatgcggtaaagcatttaattggtcctcaacactgaccaaacataaagttattcataccggggagaagccatataagtgtgaagaatgcggaaaagctttcaaccagagtagccgcctgacccggcacaagaagattcacactggcgaggagccatataaatttgaaaagtgcggccgagtgttcacatgttcttccacactgactcaggacaagaagatccacaccggggagaaaccctataactgcgaggaatgcggtaaggtgtttacatattccagtacactcaccagacataagcgcattcacacagaggaaaaaccatacaagtgtaacgagtgcggtaaggcattcaaccgctccagccacctgacctctcataggagaattcatactggcgagaagccgtataaatgtgaagagtgcggcaaagcatttaaacaatcatcgaatcttaatagccataagaagatccatagtggagaaaagccctataaatgtgaggaatgtggtaaagccttcatcttgagcagccggctgacacaacacaaaaaaattcatacaggggagaaaccctacaaatgcgaggagtgcggcaaagcattcaataggtcttcccgcctgacccaacacaagaaaatccatacaggagagaagccctataagtgcaagcagtgcgacaaagctttcactcactcttcgaatctgagttcccacaagaagatccattctggagaaaagccatacaagtgcgaagaatgcggcaaggcctttaataggtcctctcggctgacacagcataagaagatccacacacgggagaagccatacaaatgtgaggagtgtgccaaggcattcaccaggtcttcccggctgacgcagcataaaaaaatccacaggatgggtgttgttgcgcatgcctgcaaccccagtacactgggtggcaggggtggacgaattactcggtctggagacagggatcgccctggctag

SEQ ID NO: 25290 - DNA, 1731 bp, Artificial Sequence
  Description of Artificial Sequence: Synthetic coding sequence
atggatgatctgaaatatggcgtgtatcccctgaaagaagcctccggttgcccaggcgcagagaggaacttactggtgtacagttactttgaaaaggagacactcactttcagagacgtagctatcgaattctctctggaagagtgggagtgtctgaaccccgcacagcagaacttgtacatgaacgtgatgctcgaaaattataagaacctagtcttcctgggggtcgcagtctccaagcaggatcctgttacctgcttagaacaggagaaggagccatggaacatgaaacgtcatgagatggtggacgagcctcccgctatgtgctcttactttacgaaggatctatggcctgagcaggatatcaaggattcattccagcaagtcattcttaggcggtacggcaaatgcgagcacgagaatctgcaactaagaaagggctctgcgagtgtggacgaatataaggtccacaaggaaggatataacgagctcaatcagtgcttgaccacaactcagagcaaaatttttccatgtgataaatacgttaaggtgttccataagtttttgaatgctaaccggcataaaacgagacatacgggaaaaaagccttttaagtgtaagaaatgcggcaagtccttctgcatgctattacacttatctcaacataagaggatccatatcagggagaatagttatcagtgcgaggagtgtggtaaagctttcaagtggttttcgacacttacaagacacaagcgcattcatacgggagaaaaacccttcaaatgcgaagagtgtggaaaagccttcaagcagtcgtcaaccctaaccactcataagatcatacatactggcgagaaaccctatcgctgcgaggagtgcggaaaggcatttaatcgctcctcccatttaaccacccacaagattattcacacaggggaaaagccttataagtgtgaggaatgcggtaaagcgttcaaccagtcgtctacactttcaactcacaagttcatccatgcaggagaaaaaccttacaagtgcgaagaatgcgataaggccttcaacaggttttcatatttaactaagcacaaaatcattcatacaggggaaaagtcctataaatgcgaggagtgtggaaagggtttcaattggtcaagcactctcaccaagcacaagcgcatccataccggtgagaagccttacaaatgtgaagtctgcgggaaggccttcaacgaatcctccaatctgactacccataaaatgatccacaccggagagaaaccatataagtgtgaagaatgtggcaaggcatttaaccgctcaccacagcttactgctcacaaaattatccataccggggagaaaccctataagtgtgaagaatgcggaaaagccttctcacagtctagcatcctaactacgcacaagagaatccacactggggaaaagccttataaatgcgaggagtgtggcaaagcttttaatcgaagctccaacctgacaaaacacaagatcattcacacgggcgaaaagagttacaagtgcgaagagtgcggcaaggcctttaaccagtctagtacccttactaaacacaggaagattcatacccggcagaaaccttataattgtgaggagtgcgataatacattcaaccaaagtagcaatctcataaagcagaataactcctattggagggagaccttacagatgagcaggatgtgggaaagcctgtag

SEQ ID NO: 25291 - DNA, 1563 bp, Artificial Sequence
  Description of Artificial Sequence: Synthetic coding sequence
atgcctcaactgagcttatcttctttgggactgtggccaatggccgcatcgccctggttgctgctcctcctcgtcggcgcaagctggttactggctcggatccttgcttggacttacactttctacgataattgttgccgactccgctgctttcctcaaccacctaagcggaattggttcttagggcatctcgggttgatccattcaagcgaggaaggcctgctctacacacagagtctggcctgtaccttcggagatatgtgttgttggtgggttggaccatggcatgctatcgtgcgaatttttcatccgacttatatcaaaccggttctctttgcgccagcggcaatagtgcccaaagataaggtcttttactcatttctgaaaccgtggctgggggacggcctcctgcttagtgccggagaaaaatggtctagacatcggagaatgctgacaccagcctttcactttaacattctgaagccatacatgaaaatctttaacgagagcgtcaatatcatgcatgctaagtggcagttactcgcttcagagggatctgctaggctcgatatgtttgaacacatatccttgatgacattagattccctgcaaaagtgcgtctttagcttcgacagtcactgtcaggaaaagccctctgagtatatcgccgcaatcttggaactgagtgcacttgttaccaagagacaccagcagatacttctttatatcgacttcctctattacttgacccctgacggacagcgctttagacgcgcttgtagactggtgcatgacttcactgatgccgtcatccaagagcggcgtcggactctcccctctcaaggcgttgacgacttcctgcaggctaaggcaaagagcaaaacattagattttatcgatgtactgctcctgtctaaagacgaggatggaaaaaaactcagtgatgaggacatacgggctgaggccgacaccttcatgtttgaaggacacgacaccaccgcaagcggcctgtcttgggtgctgtatcatctggcgaaacacccggagtaccaggaaagatgtcggcaagaagtgcaagagctgcttaaggacagagagccaaaagaaatcgaatgggatgacctggcccagctgccattcttaacgatgtgtatcaaagagtctttgaggctgcaccctccagtccctgccgtctccagatgttgtactcaagatattgtattgcccgacggcagggtgattcccaagggaattatctgtctgatatcagttttcggaactcatcataatcccgcagtgtggcccgatcccgaagtatatgacccctttagattcgaccctaaaaacattaaggagcgttctccattagcctttatacccttctctgctgggccaagaaattgcatcggccaagccttcgcaatggccgaaatgaaggtcgtgctgggcttgacattgctgcgttttcgagtgctccctgaccacacagaaccacggaggaagccagaactagtgttgagagcagagggcggactgtggctcagagtggaaccactgagttag

SEQ ID NO: 25292 - DNA, 2022 bp, Artificial Sequence
  Description of Artificial Sequence: Synthetic coding sequence
atgatgtttcaagatagcgtggccttcgaggatgttgcggtgactttcacccaagaggaatgggctctgctcgacccctcacagaaaaatctgtgcagggatgtgatgcaggaaacctttaggaatctggcatcaattgggaaaaagtggaaaccccagaatatttacgtagaatacgaaaacttacgtcgcaaccttcgaatcgtcggcgagagactgtttgagagtaaagaaggacatcagcatggcgaaatcctcacacaggtacccgacgacatgttaaagaaaactacaaccggggttaagtcttgcgagtcatctgtttacggggaggtcgggtctgcccattctagcctcaatcgccacattagggatgacacaggccataaagcctacgaataccaggagtacgggcaaaagccatacaagtgcaaatattgtaaaaaaccttttaattgcttgtcctctgtacagacacacgaacgagctcatagcggtcgaaagctgtacgtctgtgaggagtgcggaaagacgtttatctctcattcaaacctccagcggcacaggatcatgcaccgaggcgatggaccctacaaatgtaagttttgtggcaaggctctgatgttcctctcactgtacttgattcacaagcggacgcataccggagaaaagccgtaccagtgtaaacaatgcggaaaggcattctctcacagttcttcactgagaatacacgagcggactcataccggagaaaaaccttacaagtgtaacgagtgcgggaaagcctttcacagtagtacatgccttcatgctcacaaaagaactcacactggcgaaaaaccttacgagtgtaaacagtgtgggaaagccttctcttcgagccactcctttcagattcacgaaaggacacacacaggagaaaagccttacgagtgtaaagaatgcggaaaggcattcaagtgtcctagtagcgtgagaagacatgaacgaacacacagtcgaaagaaaccttatgaatgtaagcactgtggaaaggtcttatcctacctcacatcattccagaatcatctggggatgcatacgggtgaaattagtcacaaatgtaagatatgcggtaaggcgttttatagtccatcgagtttgcagacccatgagaagactcatactggtgagaaaccttataagtgcaaccagtgtggaaaggccttcaatagcagttccagcttccggtatcacgagaggacacacaccggagaaaagccttatgaatgcaagcagtgtggcaaagcctttcggtcggccagcctgttacagacacatggccgtacacacacaggtgagaaaccatacgcctgcaaagagtgcggcaaaccgttttctaacttttccttcttccaaatccacgagcgaatgcacagagaggagaagccctatgagtgcaaaggatatggtaagactttcagcctgccctctctgtttcaccggcacgagcggacccatacaggtgggaagacctatgagtgtaagcagtgcgggagaagcttcaattgctcctcttcctttaggtaccatggcagaacccataccggtgaaaagccatacgagtgcaagcaatgcgggaaagcattcagatcagccagccagctccagattcacggacgtacccatactggcgagaagccgtacgagtgcaagcaatgtggaaaagccttcgggagcgcctcccatctgcagatgcatggaaggacgcacaccggggagaaaccatacgaatgtaaacagtgtgggaagtcattcggttgcgcatcccggctccaaatgcacggtagaacacacaccggcgaaaaaccgtacaagtgcaagcagtgcggtaaggctttcggctgccctagcaatctgcggaggcatgggcgtactcatactggagaaaagccttacaaatgtaatcaatgcggcaaggtctttcgctgctcaagccaactccaagtccacggaagggcccactgcattgacacgccatag

SEQ ID NO: 25293 - DNA, 1917 bp, Artificial Sequence
  Description of Artificial Sequence: Synthetic coding sequence
atgcaggaaacatttcggaatttggctagcatcggcaaaaagtggaaaccgcagaatatatacgtcgaatacgagaacctcagaaggaatctgaggattgtcggggaaagactgtttgagtccaaggagggtcaccagcatggcgagatcctgacacaggtccctgacgacatgctgaaaaaaactaccacgggcgtgaaaagttgtgagtccagcgtttacggggaagtggggtcagcacatagttcattgaataggcatatccgggacgatactggccataaagcttacgaataccaggagtacgggcaaaaaccatataaatgtaagtactgcaaaaaaccgtttaattgcctctcatccgtccagactcacgagagggcccatagcggcagaaaattgtatgtctgtgaagaatgcggaaagaccttcatctcacactcaaaccttcagcgccaccgaatcatgcaccgcggagacggcccttacaaatgtaaattctgtggtaaggcgctgatgtttctgtccctctatctgatccacaaacggacccataccggagagaagccgtatcagtgcaaacaatgcggcaaggctttcagccattccagctcactgagaatacatgaacgcacgcacaccggagaaaagccatacaagtgtaatgaatgtggtaaagccttccacagctcaacgtgcctccatgctcacaagcgcacacataccggcgaaaagccctacgagtgtaagcaatgcggcaaagcattcagttctagccacagcttccagatccatgagcgcacgcataccggtgaaaagccgtatgagtgtaaagagtgtgggaaggcattcaaatgccccagctctgtgcgtcgacacgagaggacccacagtcggaagaagccttacgaatgtaagcactgcgggaaggtcctgagctatctgacaagctttcaaaatcaccttggaatgcacacaggagaaatctctcataaatgtaaaatttgtggcaaggcattctatagccccagcagcctgcagacccacgaaaagacccatactggagagaagccctataaatgcaaccagtgcgggaaagcattcaactcttcctcctcttttcggtaccatgagagaactcatacgggggaaaagccctatgaatgcaaacaatgtggcaaggcttttcgtagcgctagtcttttacaaacgcatggtaggactcacactggagaaaagccgtacgcttgcaaggagtgtggcaagccattttccaatttcagtttcttccagatccacgaacgtatgcatcgagaggagaaaccctatgaatgcaaaggctacggtaaaactttcagcctcccaagcctgtttcaccgccacgagcgaacacatacaggcggaaaaacttatgaatgtaagcagtgcgggagatccttcaattgcagttcaagctttagataccacggtaggactcacaccggcgaaaagccttacgaatgcaagcagtgcggaaaagccttccgttctgcatcgcaactgcaaatacatggtagaacacataccggtgagaaaccgtacgagtgcaaacaatgtggcaaagcctttgggagcgccagccatctgcagatgcacggacggacccacaccggcgagaagccgtacgagtgtaaacagtgcgggaaatcctttggatgcgctagcaggctgcagatgcatggcagaacgcacactggcgaaaaaccctacaagtgcaagcagtgcggaaaggcatttgggtgcccgtctaatctccgacgtcacggaagaacgcatacaggagagaaaccatacaagtgtaaccagtgcggcaaagtgtttagatgttctagccagctgcaggtgcacgggagagcacactgtattgatacaccttag

SEQ ID NO: 25294 - DNA, 159 bp, Artificial Sequence
  Description of Artificial Sequence: Synthetic coding sequence
atgcaggagacctttagaaatctcgcctctatcggaaagaagtggaaacctcagaacatctatgtagagtacgagaatctgcgcagaaatcttagaatagttggagagcggttgttcgagtccaaagaaggacatcagcatggagaaatactaacatag

SEQ ID NO: 25295 - DNA, 360 bp, Artificial Sequence
  Description of Artificial Sequence: Synthetic coding sequence
atgcaggagacctttcgcaacctggcctccatagggaaaaagtggaagccacagaatatctacgtggagtatgagaacctgcggagaaatctccgcattgtgggggagcggctctttgaatccaaagaaggtcatcaacatggcgaaatccttacacaggtccccgatgacatgttgaagaagacaaccacgggtgtgaaaagttgcgaaagctctgtgtacggcgaggtgggatcagcccatagtagtcttaatcggcatatcagagatgacacaggccacaaagcatatgagtaccaggagtacggtcaaaagccctacaagtgcaagtactgcaaaaaacctttcaattgtctgtag

SEQ ID NO: 25296 - DNA, 1458 bp, Artificial Sequence
  Description of Artificial Sequence: Synthetic coding sequence
atgcgtgacaacagggctgtcagtctgtgccagcaagaatggatgtgtcccggaccggcacagagagcactgtatagaggcgcaactcaacgcaaggattcacatgttagcttggcaacaggagtgccttggggttatgaagaaactaaaaccctccttgccatcctcagtagtagtcagttctatgggaagctgcaaacatgccagcagaattcccagatttaccgcgcaatggcagaaggcctgtgggagcagggtttcttgcgtaccccagagcagtgccgcaccaaattcaagtcattacagctaagttaccggaaggtgcgccgaggccgagtccccgagccttgcatcttttatgaagagatgaatgccttgtcgggttcttgggcctctgcacctcccatggcctccgacgctgtgcccggacaggagggcagcgacattgaagccggagagctgaaccaccagaatggcgagccgacagaagtcgaagatggaaccgtcgatggagctgatcgggacgaaaaagattttaggaatcccggacaggaagtaaggaagcttgacctgcccgtgctgtttcctaacagactgggatttgagtttaaaaacgagatcaagaaggagaacctcaagtgggatgactccgaagaggtggaaatcaataaagccctccaaagaaagtccaggggggtctactggcactccgaactccagaagggattagagagcgaacctacgtcccgtcggcagtgtcgtaactcacctggcgagtctgaagagaaaacgcccagtcaggagaagatgtcccatcagagcttttgtgcccgagataaggcctgcacccacattctctgcgggaagaattgctcgcaatcggtacactctccccataaaccagccctgaaactcgaaaaagtgagccaatgcccggagtgtggaaagacattttcaagatcctcataccttgtgagacatcagagaatacacaccggggagaaaccccacaagtgctctgagtgcggaaaaggctttagcgagcgcagcaaccttacggcgcatctaagaacacatactggagagcgcccatatcagtgcggccagtgcgggaaaagcttcaaccagtcctcaagccttatagtgcatcagagaacacatactggagaaaagccctatcagtgtatagtatgtggtaagagattcaataattcatcacagttttctgcccacagacggatccacacaggcgagagcccctacaagtgtgcggtttgtggaaaaattttcaataattcatcgcacttctcagcccaccggaaaacccacacaggcgagaagccatacaggtgttctcactgtgagcggggtttcacaaaaaattccgccctcacgcgacaccaaaccgtgcatatgaaggctgtcctttcctcacaagaaggtagggacgcactatag

SEQ ID NO: 25297 - DNA, 2094 bp, Artificial Sequence
  Description of Artificial Sequence: Synthetic coding sequence
atgatggctgccgtcaagagtactgaagcccatccctcttcaaataaggatcctacccagggacaaaagtcagccctgcagggcaactctcctgattcagaggcatcaaggcagagattcagacaattctgttaccaggaggtgacaggcccacatgaggcattctccaaactgtgggagctgtgctgtcaatggcttaggccaaagacccactctaaagaggagatcctagagcttctggtcttggaacagttcctgaccattctacctgaggagatccaaacctgggtgcgggagcagcatccagaaaacggtgaggaagcggtcgcactggtggaagacgtgcagagggcaccagggcagcaggttctggattcagaaaaggacctgaaagtgctgatgaaagaaatggcacccctaggcgcaacacgggaaagtttgcgctctcagtggaagcaggaggtacagccagaggaaccaactttcaagggcagtcagagttcccatcagcgaccaggcgagcagtctgaggcctggctcgccccacaggcccctcgtaatctgccccagaatacaggtttgcacgatcaggagacaggtgctgtcgtttggacagccggaagccaaggtcctgctatgagagacaaccgggcagtctcactctgccagcaggagtggatgtgcccagggccagctcagagggcactatatagaggtgcaacccagcggaaggactctcacgtatctctggcaaccggagtgccatggggttacgaggaaacaaaaacccttctggctattttgagcagtagccagttttatgggaagctccagacctgccagcaaaacagtcaaatataccgcgctatggctgaggggctatgggagcaggggttcctcaggactcctgaacagtgtagaaccaaatttaagagcttgcagctgagttatcgaaaggtacgccgaggacgggtgccggagccttgcatcttctacgaagaaatgaacgctctgagtggtagctgggcttctgctcctcccatggcctccgatgcggtgcctggacaggagggatctgacattgaggcaggcgagctcaatcaccagaatggggaacccaccgaagttgaggacggaaccgttgacggagccgatagggatgaaaaggatttccgcaatccaggccaggaagtgcgcaagcttgacctgcctgtgctctttccaaataggttggggtttgaatttaaaaacgagataaagaaagagaaccttaaatgggacgacagcgaggaagtcgagatcaacaaggccctgcagagaaagtccaggggcgtttactggcattccgaactgcagaaggggctggagagcgaacccacctctcgtcgccagtgccgcaacagtcctggcgagtccgaagagaagaccccgtctcaggaaaagatgagccaccaatcgttttgcgctagagacaaggcctgcacgcatatcctgtgtggtaaaaactgttcacagtcagttcatagtccacataaaccggctttgaaactagagaaagtctcgcagtgtcctgaatgtgggaaaaccttttctcgcagctcctatcttgttcggcatcagagaatacacacaggcgagaaaccacacaagtgctccgagtgtggcaaaggctttagtgagagatccaaccttacggctcacctccgcacccataccggagaacgtccatatcagtgtggtcagtgcggtaaatcctttaaccagtcatccagcctcattgtgcaccagcggactcataccggcgaaaaaccttaccagtgcatcgtgtgcggtaagaggttcaataattcctctcagttctccgcacacagaaggattcacaccggggagtccccttacaagtgcgccgtatgcggcaaaatatttaataacagctctcatttcagcgcccacaggaagacgcacactggagagaagccttaccgatgctctcactgtgagaggggattcacgaaaaacagcgctttgacgcgccaccagactgtacacatgaaggctgtcttgtcttctcaggaggggcgagacgcattatag

SEQ ID NO: 25298 - DNA, 2094 bp, Artificial Sequence
  Description of Artificial Sequence: Synthetic coding sequence
atgatggcagccgtgaaatctaccgaagcacatccatccagcaacaaagaccctacccagggtcagaaatcagccctccagggtaattcaccagacagcgaagcttctcggcagcgtttccgacagttttgttaccaagaagttacagggccacacgaagccttctcgaagctgtgggagctgtgctgccagtggttgaggcctaagacacactctaaagaggagattctggagcttctcgtccttgaacaattcctgactatactccccgaagagatccaaacctgggtgcgggagcaacatcctgagaacggagaagaagccgtcgccctggtcgaggatgtgcaacgcgcacccggtcaacaggtactggatagcgagaaagacctcaaggtgctgatgaaggagatggcccctttgggggctacacgagagtcactgcggtcccagtggaaacaggaagtgcagccggaggagcccacatttaaaggtagccaatctagccaccagcgtcccggagagcagagcgaggcctggctcgccccacaggcaccgagaaatctgccccagaacacgggcctccatgaccaggagaccggtgccgtagtgtggaccgccggtagccagggacccgcaatgcgcgacaatagagccgtgagtctgtgccagcaggagtggatgtgtcccggtcccgctcagagggcactctatcgcggagctacacagcggaaagatagccacgtgagccttgccacgggggtcccttgggggtatgaagaaaccaagactctattggcgatcctctccagttcccagttttacggtaagctgcaaacgtgtcaacaaaattctcaaatctaccgagccatggcagagggactctgggagcaagggtttcttaggacccccgaacaatgtagaacaaaattcaagagcctgcaactctcttaccgaaaagtgcgcagggggagagtgcccgaaccttgtattttctacgaggaaatgaatgcattatcgggttcctgggcatccgccccaccaatggcttcagacgctgtgccaggacaggaagggtcggatatagaggctggcgagctcaatcatcaaaatggagaaccgacagaagttgaggatggtaccgttgacggtgccgaccgagatgagaaggatttccgcaacccaggccaggaggtaaggaaactagatcttccggtcctgttccccaataggctgggtttcgagttcaaaaacgagattaagaaagagaatttgaagtgggacgacagcgaagaggtcgaaattaataaagctctccagagaaaatcacgaggagtctattggcatagtgaacttcagaagggactggagtcagagcccacaagccgtaggcaatgtcggaattcacctggcgaatccgaggagaagacaccatctcaggagaagatgtctcaccaaagcttttgtgccagagacaaggcctgtactcatattctctgtggcaagaattgtagccaaagtgtacacagccctcacaagccagcactcaagctggagaaggtctctcagtgtccagaatgcggaaaaaccttcagtcgatcctcctacctcgtgcgtcatcaacgcatccacacaggcgagaagcctcacaaatgtagtgaatgcgggaagggtttctcagagcgaagcaacctcacagcacacctcaggacgcacacgggggagaggccgtaccagtgcggacagtgcgggaaaagctttaatcagagcagctcgctaattgtccatcaacgtacacacacaggagagaagccctaccagtgtatcgtatgtggaaaacgatttaacaattcatcacagttctctgctcatagacgcattcacaccggcgaatctccctacaaatgcgccgtgtgtggtaagatctttaataattccagccactttagtgctcatcgcaagacccatacaggcgagaaaccctatcggtgttcccactgcgagcggggattcacaaagaattccgctctaacacgccaccaaactgtacacatgaaggccgtgctttcatcacaggaaggcagggacgctttgtag

SEQ ID NO: 25299 - DNA, 771 bp, Artificial Sequence
  Description of Artificial Sequence: Synthetic coding sequence
atggccgctgttaagtctaccgaagctcaccctagttcaaataaggacccaacccagggccagaagtcagctctgcaaggcaactccccggactccgaagccagccggcagagattcaggcagttttgttatcaagaagtaacaggaccacacgaggcgttttctaagctatgggagctttgttgtcaatggctacggccaaagacacactcgaaggaggaaatcctggagctcctcgtccttgaacaatttttgacaattctgccggaggagatccagacttgggtccgggaacagcatccagagaacggcgaggaggccgtggccctggtggaggatgtacagagggctccagggcagcaggtgctggactccgaaaaggacttaaaggtcctgatgaaagagatggccccactgggcgctaccagagaaagcctgcgatcacagtggaagcaggaagttcagccagaagagccaacctttaaaggttcccaaagttctcaccagaggccgggagaacagagcgaagcgtggttggccccacaggctcctaggaatttgccccagaataccggcttgcacgatcaggagacaggagccgtcgtatggacagcaggctctcaggggccagcgatgagagacaacagggcagtgtcattgtgccagcaagagtggatgtgccccggtcctgcccagcgtgccttgtatcgaggagcaactcaacgcaaagacagtcatgtgtcgctggctacaggagctctcgggctctag

SEQ ID NO: 25300 - DNA, 648 bp, Artificial Sequence
  Description of Artificial Sequence: Synthetic coding sequence
atgcgggacaacagagccgtctcactgtgccagcaggaatggatgtgcccgggacccgcacagcgagcgctttatcggggagctactcaaagaaaagactcccacgtgagcctggccaccggcgttccgtgggggtacgaggagacgaagactctgctggccatactgagtagttcccaattttacggtaagctgcagacatgccagcaaaactctcagatttacagagccatggcagagggcttgtgggagcaggggttcctcaggaccccagagcaatgccggaccaagtttaagtccctgcagctgtcatatcgcaaggtgcggaggggcagggtgcctgaaccctgcatattttacgaggagatgaacgctctttccgggtcatgggctagtgcgccacctatggcctctgacgcagtgcctggtcaagaagggtcggacatcgaggctggagaactgaaccatcaaaacggggagcccactgaagttgaagatggaaccgtggacggagccgaccgagacgagaaagattttcgcaaccccggacaggaggtgcggaagctagatctgcccgttcttttccccaaccgcctcggaaagactcccttggccctgatggttaaaggctggcagtcacccctctag

SEQ ID NO: 25301 - DNA, 1227 bp, Artificial Sequence
  Description of Artificial Sequence: Synthetic coding sequence
atggcagagggactgtgggagcagggcttcctccgaacacctgaacaatgcaggaccaagtttaaaagcttacagttgtcctatcggaaagtgcggcgtggccgagtgccagagccatgcatattctacgaggaaatgaacgctcttagcggatcttgggcctcagctcctcctatggctagcgacgccgttcctggacaggaagggagcgatatcgaggcaggtgagctgaatcatcaaaatggcgagccaaccgaggttgaggacggtacagtggacggagccgatagagacgaaaaggattttcgcaatccaggtcaggaagtgcggaaacttgatctcccagtcctgtttcctaatcgattgggttttgagttcaaaaatgagattaaaaaagagaatctcaaatgggacgactctgaggaagttgagatcaataaggccctgcagcgtaaatcaagaggcgtctactggcatagcgaactccagaaggggctggaatcggaaccaacaagccgacgccagtgccggaatagccctggcgaatcagaggagaagactcctagccaggaaaaaatgtctcatcaaagcttttgtgcgagagacaaagcatgtacacatatactgtgtgggaagaattgtagtcagagtgtgcacagcccacacaaacccgctcttaaactcgaaaaagtgagccagtgtcctgaatgcggcaagactttcagccgcagtagctatctggtccgccatcagcggatccacactggcgagaaaccccataagtgcagcgagtgtggtaaaggtttttccgagaggagcaatctcacggcccatctgagaacacatacaggcgagagaccttatcaatgcggacagtgtggtaagagtttcaaccagagctccagtctcattgtacatcagaggacccatacaggcgaaaagccttaccaatgtattgtgtgcggcaagagattcaataatagctctcagttttcagcgcacagacggatccacactggggagagcccttataaatgcgcagtgtgtggaaaaatttttaataacagtagtcacttctctgcccaccgaaagactcatacaggagaaaagccataccggtgcagtcactgcgagagagggtttactaaaaattcagccctgactagacaccaaacagttcacatgaaagccgtgctgagcagtcaggaaggcagagacgccttgtag

SEQ ID NO: 25302 - DNA, 2457 bp, Artificial Sequence
  Description of Artificial Sequence: Synthetic coding sequence
atggattcggagtcgaacatcccatctggaactattcaatctagaaaaggactgcagaataaatcccagttccggacaattgcccctaaaatagtgcccaaggtgctaacctccaggatgctgccttgtcactccccctcaagatctgaccaggtgaatctcggaccatctattaactccaagttactggggatgagcactcagaactacgccctgatgcaagtagccggacaggaaggaaccttttcattggtggccttaccacacgtggcttctgcccagccaatccagaagcctagaatgagcctgcccgaaaaccttaagctccccattcccagatatcagccgcctcgcaatagcaaggccagtaggaaaaagcccattcttatctttcctaagagcggatgctctaaagcccctgctcagacccaaatgtgcccgcagatgtcccccagccctcctcaccaccccgagttactgtacaagccgtcaccctttgaggaggttccatctctcgaacaggcccctgccagtatttctacagctgcacttactaatggaagcgaccacggggacctgcgtccaccagtcactaatacccacggcagcctgaaccctccagcgaccccagcctcttccacccctgaagaacccgcaaaacaagatctcacggcattatctggcaaggcacacttcgtctccaagataacctcatcaaagccatcagccgttgccagcgaaaagtttaaggaacaggtcgatctggccaaaactatgaccaacctgagtcccacaatcctcgggaatgcagtccagctcattagcagcgtgcccaaggggaagttaccaatccctccttacagcaggatgaagactatggaggtgtacaagatcaagtccgatgcaaacatcgctgggttttctctgcccggtcccaaagctgactgcgataaaattccgtcaaccaccgaaggctttaatgccgcaacaaaagtggcttcaaggctgcctgttccacaagtgagtcagcaaagtgcatgtgagtccgccttctgcccacctaccaaactggacctgaaccataaaacaaaattaaactccggagccgctaaacgcaaggggcgtaagcggaaggtccctgacgaaattcttgcatttcagggcaagcggcgtaaatatattataaacaagtgcagggatggcaaggaacgcgtcaagaatgatcctcaggagtttagggaccagaaactggggaccctcaaaaagtacaggtctatcatgcctaaaccgatcatggtaatcccgaccttggctagcctggcatctcctaccaccctacagtctcagatgctaggagggttggggcaagacgtgctgttaaacaacagtctgacaccgaagtatctgggatgcaagcaggacaatagtagcagcccaaaacctagttctgtcttccggaacggtttttccggaataaaaaagccttggcatcgctgccacgtttgcaaccaccatttccagtttaaacagcacctccgagatcacatgaacacccacactaatcgacggccatatagctgtcggatctgccgaaagtcctatgtgcgcccaggcagcttgtcgacacacatgaaactccaccacggcgaaaacaggttgaagaagttgatgtgctgcgaattctgtgctaaagtctttggccacatccgggtctactttggccatctcaaggaggtgcatcgtgtagtgatctcaacggagcccgctcccagtgagttgcaaccaggggatatccccaaaaatcgagatatgagtgtgcgagggatggaagggagtctagagcgtgagaataagtcgaacctggaggaagacttcctcctgaaccaggccgacgaggttaaattacagattaagtgcggccgatgccagatcacagcccagagctttgctgagatcaagttccatcttcttgatgtgcatggtgaggagatcgaaggaaggttgcaggagggtacgttcccagggtcaaagggaacccaagaggagcttgtacagcacgcatcccctgattggaaacgtcatcccgagagggggaagcctgaaaaagtacattccagttctgaggagtcccatgcatgtccccgtctgaagagacagctgcacttgcaccagaacggcgtggagatgttaatggagaatgaaggaccacagtccggtaccaacaaaccccgagagacctgccaaggaccggagtgcccaggcttgcacaccttcctgctttggagccactctggctttaactgtttactgtgcgctgagatgctaggcagaaaggaggatcttctccaccactggaagcaccagcataactgcgaagatcctagcaagctctgggctattctgaataccgtctccaaccagggcgtcattgaactcagcagtgaggccgagaaatag

SEQ ID NO: 25303 - DNA, 2487 bp, Artificial Sequence
  Description of Artificial Sequence: Synthetic coding sequence
atgcaaaactctgtttcagtccctccaaaagacgaaggggagagtaatataccctctggtaccatccagagtaggaaaggactgcagaacaagagtcaattccggaccattgcccctaaaatcgttcccaaggtgttaacatcacgaatgctgccatgtcactccccttctcggtcagatcaggttaacctaggcccttcaataaactctaagcttctggggatgtcaacacagaattatgcacttatgcaagtggcaggtcaggagggcacgttctcgttggtggccctcccgcacgttgcaagcgcccagcctatacagaagcccagaatgtctctgcctgagaatctgaagctccctataccccgataccagccccctcggaactcgaaggcaagccgtaaaaaaccgattctgatcttccctaagagtggatgctctaaagccccagcccagacacaaatgtgtcctcagatgtcgccctcccctccgcaccaccccgaactgctgtacaagccaagtccatttgaagaggtcccgagtcttgaacaggcacctgcaagtatttcaacagctgccttgacaaacgggtcagaccacggagacctgcgcccaccggtaaccaatactcacggcagtctgaatccccctgccactccggcttctagcacccccgaggaaccagccaaacaggacctaactgccctgagcggtaaagctcacttcgtgtcaaagattacctctagtaagccctccgcagtggcaagcgagaaatttaaggaacaagtcgacttggctaagacgatgactaacttgtctcctactatcctgggcaacgcggtgcagcttattagtagcgtgccaaaaggaaagcttcctattccaccatactcgcgtatgaaaacaatggaggtctataaaatcaaaagtgacgccaatatcgcaggatttagcctgccaggtcctaaagctgactgcgacaagattcctagcaccaccgagggattcaacgcagcaactaaggtggccagtagactcccagtcccccaggtgagtcaacaatccgcctgtgaaagcgccttttgtccaccaacgaaactggacttgaatcataagactaaattaaatagtggcgctgccaagcgcaaggggcgaaaacgcaaggttccggacgaaattctcgcctttcagggtaagcggaggaaatatatcataaataagtgccgagacggcaaggagagggtcaagaacgatcctcaggagtttcgcgatcagaagttgggtactctgaagaagtacagaagtattatgccaaagcccattatggtgattccgaccttagcatctctcgcttcacctaccactctccaatcccagatgctgggtgggctcgggcaagatgtcctgttgaataacagcctcacccctaaataccttggatgtaagcaggacaactcatcatcccctaaacccagcagcgtgttccgcaatggtttttctggcattaagaagccatggcaccggtgtcacgtgtgcaaccaccacttccagtttaagcaacacctgagggatcatatgaacacccatacaaacagacgcccttactcatgtcggatatgccgaaagagctacgttcgcccaggcagtctatctacgcacatgaaattgcaccacggcgagaacaggttaaagaaattgatgtgctgcgaattctgcgccaaggtgtttggacacatccgggtgtatttcggacacctcaaggaagtgcaccgggtcgttatatccactgagcccgctccttctgaattgcagcctggggatatccctaaaaacagagatatgtcagtgcgaggcatggaggggtcccttgagagggagaataaatcaaaccttgaagaggatttcctcctcaaccaagctgatgaggtcaagcttcagataaaatgtggacgatgccagataaccgcccagtcattcgccgagattaagttccatctgcttgacgtccacggcgaggagattgagggaaggctacaggaaggaacattccctgggtctaaaggtacccaggaagagcttgtgcagcacgcctcaccggactggaaaaggcatccagagagaggtaaacccgaaaaagttcatagtagcagcgaagagagccacgcttgcccgagactgaagagacagctccacttgcaccagaatggcgtcgaaatgttgatggaaaacgagggacctcagagcgggactaacaagccacgggaaacttgtcagggtcctgagtgcccaggactgcataccttcctgctctggtcacacagcgggttcaactgtctgttatgcgcagagatgctgggccgtaaagaggacctattgcaccattggaagcaccagcataactgcgaagatccaagtaagttatgggccatcttgaacaccgtttccaaccagggcgtgattgaactgagcagtgaagcggaaaagtag

SEQ ID NO: 25304 - DNA, 1179 bp, Artificial Sequence
  Description of Artificial Sequence: Synthetic coding sequence
atgccaaagcccatcatggtgatcccaaccttggctagtcttgcatcccctactacgctacaatcccagatgcttggcggactgggccaggacgtgttgctgaacaacagtctgaccccaaagtacctgggctgtaagcaagacaatagttctagccctaaacctagtagcgtattcagaaacgggtttagtgggatcaagaaaccgtggcatcggtgccacgtttgtaatcatcacttccaatttaagcagcatttgagggaccacatgaacacacataccaatcgcagaccttatagctgccgcatttgccgcaaaagctatgttagacccggatcactgtccacacacatgaagctgcaccatggtgagaacaggctaaagaaacttatgtgctgtgagttctgtgccaaggtgttcgggcatatccgagtatactttggacacctgaaggaggtgcatagggtcgtgatctccaccgagcctgccccttctgaactgcagcctggcgatattccaaaaaaccgggacatgagtgtgagaggcatggaaggcagcctggagcgagaaaataaatctaacctggaggaggattttctcctgaaccaggctgatgaggtgaaactccagattaaatgcggccgttgtcagattaccgcccagtctttcgccgagattaaatttcatctgttggatgttcacggggaggaaatcgaaggtaggttacaggagggcaccttccccggtagcaagggcactcaggaggaacttgtgcagcacgcctctcccgattggaagagacaccccgagagaggaaagcccgagaaagttcacagctcttccgaggagagtcatgcttgccctcggctgaagaggcagctgcatctgcaccagaatggcgtggaaatgcttatggaaaatgagggcccacaatctggcactaataagcctagagaaacatgccaaggaccggagtgtcctggactacataccttcttgctgtggtcccattctgggttcaactgtctgctgtgtgccgaaatgctgggtcgtaaagaggatttactgcatcactggaagcaccagcacaactgcgaggaccctagcaaactgtgggcgatcctgaacactgtatctaatcaaggagtaattgagctgagttctgaggcagagaagtag

SEQ ID NO: 25305 - DNA, 2487 bp, Artificial Sequence
  Description of Artificial Sequence: Synthetic coding sequence
atgcagaactccgtgtccgttcccccaaaagatgagggggagagcaatataccctcgggaactattcagtcacggaagggtctccagaataaatctcaatttagaacgatcgcaccgaaaatcgtaccaaaagtacttacttcaaggatgctgccttgccactcccctagcaggagcgaccaggtcaatctgggaccttctatcaatagcaagttattggggatgagcactcagaactacgccttgatgcaagtggcgggtcaagagggaacgtttagtctcgtggccctgccccatgtcgcaagtgcccagcctatccaaaaaccaaggatgtccctgcccgagaacctgaagttgcctatcccacgctatcaaccccctcgcaactctaaggcatcccgtaagaagcctattctgatcttcccaaagtctgggtgctccaaagcccctgcccagacgcagatgtgtcctcaaatgagtccgtcgccccctcaccacccagagctgctgtacaaaccgtctccgtttgaggaggtgccatctctggagcaggcccctgccagcatttcaacagctgctctgactaacggttctgaccatggcgatcttcgcccaccagtgactaacactcacggatccctgaaccctcctgcaacccccgcaagcagtactcctgaagagcccgctaagcaggacttgacagcacttagcggaaaggcccacttcgttagtaaaatcactagctcaaagccctcagctgtagcctccgagaaattcaaagagcaggtcgacctggcaaagaccatgaccaacctgtcaccgacaatactcgggaacgctgtccagctgatttcctccgtgcctaaagggaaactaccgattcccccttatagccgtatgaagacaatggaagtgtacaaaatcaaatccgacgctaacattgctggcttcagcctacctggacccaaagctgactgtgataagatcccctcgacaaccgagggctttaacgcggcaactaaggtggccagtagactccctgtaccccaagtgagccagcagagtgcatgtgagtccgcgttttgtcccccaactaagttagacctgaatcacaaaacgaagcttaatagtggggctgccaagaggaagggcagaaaacgcaaagtgcctgacgagattctggcctttcagggcaagcgacgtaagtatatcattaataaatgccgggacggcaaggaacgcgtcaaaaacgacccccaggagtttcgtgatcagaaactgggaactctgaaaaagtacagatcaatcatgcccaagccgataatggtcattcctacacttgcgtcactggcctccccaaccacacttcagtcccaaatgctgggcggtctgggtcaagacgttctgctgaataacagcctgactcctaaatacctcgggtgcaagcaagacaattctagctcccccaaaccatcctcagttttccgcaatgggttctcaggcatcaaaaaaccctggcatcgctgccacgtgtgcaaccatcacttccagtttaagcagcacctgcgcgaccatatgaatactcatacaaaccggaggccttacagctgccggatctgcaggaagtcctacgtccggcctgggagcttgtctacccatatgaaactgcatcacggcgagaaccgtctgaaaaaattgatgtgctgcgagttttgtgccaaggtgtttggccacatcagggtttatttcggacaccttaaggaggtccatcgcgtcgtgatcagcactgagccggcacctagcgagttacagccaggcgatatacctaagaatagagacatgtcagtgagagggatggagggttctctggagcgtgaaaataagtccaatttggaagaggattttctgcttaatcaggccgatgaggtcaagttgcaaattaagtgcggaagatgtcagatcaccgctcagtcctttgctgagatcaaatttcatctcctggacgtacatggtgaggagatcgaggggcgacttcaggaaggtacattccctggaagcaagggaacacaggaagagctcgttcaacatgcaagcccagattggaagaggcaccctgaacgtggcaagcccgagaaggtgcacagcagctccgaggaatctcacgcttgccctcgccttaagagacaactgcacctgcaccagaacggggtggaaatgctgatggaaaacgaagggccacaaagcggcacaaacaagcccagggaaacctgtcaggggcctgaatgtcccggacttcacactttcttgctgtggtctcactcaggatttaactgcctgttatgcgcagaaatgttgggacgtaaagaagatctgctgcatcattggaaacatcagcataattgcgaggaccccagcaaattatgggccattttgaataccgttagcaaccaaggtgttatcgagttatcatctgaggctgagaaatag

SEQ ID NO: 25306 - DNA, 1644 bp, Artificial Sequence
  Description of Artificial Sequence: Synthetic coding sequence
atgcagaattctgtatctgtcccgccaaaagatgagggggaaagcaatattcccagtggtaccatacagagcagaaaaggcctccaaaataagagccagttccgcactatagcaccaaaaatcgtgcctaaagtcctgaccagtagaatgctcccgtgccattcaccctctcggtcggatcaggacctgaggcctacagttatccgatacccccctccacagaaggccctcatgcagcctccgagatggcaagcagggtatttgttccacaaaacgaaactaaatagcggagctgccaaacgcaagggaaggaaaaggaaggtgcccgatgaaatcttagccttccagggaaaacgtcggaagtacattataaacaagtgccgggatggcaaagagcgcgtgaaaaatgatcctcaggaattcagggaccagaagctcggcaccctgaaaaaataccggtccataatgcctaagcctataatggtcattcctaccctcgcatctctcgctagccccactacacttcagagccagatgttgggcggactcgggcaggacgtcctgttaaataattcacttacacctaagtaccttggctgtaagcaggacaattccagtagccctaagcctagttctgtgtttagaaatggctttagcggtatcaagaaaccctggcatcggtgtcatgtatgcaatcatcatttccagttcaagcagcatctgcgggaccacatgaatactcacaccaaccgccgaccttactcatgcagaatctgtaggaagagctacgtgaggcccggtagtctttccacacacatgaaattgcaccacggcgagaatcggctcaagaagcttatgtgctgcgaattctgtgccaaggtgttcgggcatattagggtctatttcggccacctgaaagaggtgcacagggtcgtgataagcactgaacccgctccaagtgaactccaaccaggcgacatccccaaaaaccgggacatgtccgtgaggggtatggaaggcagtttggaacgagaaaacaagagcaacctggaggaagactttctgctgaatcaagccgatgaggtgaagctgcagatcaagtgcggaagatgtcaaatcacggctcagagttttgctgaaattaaattccacctactcgacgtgcacggggaggagattgaaggacggctgcaggagggtactttccccggttcgaagggaactcaggaggaactcgtgcagcacgccagcccagactggaagcggcaccccgagagggggaagcccgagaaagtgcactctagcagcgaggaatcacacgcttgtcctaggttaaaaaggcagctgcacttgcaccagaatggggtagaaatgctcatggagaatgagggcccacagtccggcaccaataagcctagagaaacttgccaagggccagagtgtccagggttgcacacatttctgttgtggagtcatagcgggtttaattgcctcctgtgcgctgagatgctggggagaaaagaagacctccttcatcattggaagcaccagcacaactgcgaggatcccagcaaactctgggccattttgaataccgtgtccaatcagggcgtgattgaactgagcagtgaagccgaaaagtag

SEQ ID NO: 25307 - DNA, 2487 bp, Artificial Sequence
  Description of Artificial Sequence: Synthetic coding sequence
atgcaaaactccgtgagcgttccccctaaggatgaaggcgaatccaacataccaagcggcactattcagagccggaagggattgcagaacaagagtcagtttcgcacaatcgctcctaagattgttccaaaagtgctgactagccgaatgctcccctgccattcccctagtcgcagtgatcaggtcaacctcggcccttcaattaactcaaagctcttaggcatgagcacacagaactatgccctgatgcaggttgccggtcaggaaggaactttttcactcgtcgccctgccacacgtcgcttccgcccagccgattcagaagcctcgaatgagcttgcccgagaatctgaagcttcccattcctcggtatcagcctccccgaaatagcaaggctagcagaaagaaacccatactgatcttcccaaagtccgggtgttcaaaagcaccagcgcagactcagatgtgccctcagatgagcccaagcccccctcaccatccagaactgctgtacaagcctagcccctttgaagaggtgccgtcactagaacaagctccagcatccatttctacagctgcattgactaatggttccgatcatggagatttgcgacccccagtgacaaatacgcatggttccctaaacccacccgcaacccccgcttcctccacccccgaggaacccgctaaacaggatcttactgcgctgtctgggaaggcgcattttgtcagtaagataacatcctctaagccttcagccgttgcatcggagaagttcaaagagcaggtcgacctggcaaaaaccatgaccaatctttcgcccacaattcttgggaacgccgttcagctgatcagcagcgtacccaagggtaagctgcccattcccccatacagccgcatgaagacaatggaggtgtacaagattaagagcgatgccaacatagccggtttttccctcccagggcctaaggcagattgcgacaaaatcccatcaaccaccgagggtttcaacgccgctacaaaggtagctagcaggctgcctgttccccaagtgagccagcagtccgcttgtgaaagcgctttctgccccccaacgaaattagaccttaatcataagactaaactgaattccggcgcagccaagagaaagggcagaaagagaaaggtccccgacgaaatactggcatttcaagggaagcggcgtaaatatatcatcaacaaatgtagggacgggaaggaaagggtcaaaaacgatccacaggagttccgcgaccagaagctcggcacgctcaagaagtacagatcaatcatgcccaaacctatcatggtgatccctactctggcatcgctggcttctcccaccacactgcagagccagatgttagggggattggggcaggatgtcctcctaaacaacagcctgacaccaaagtatcttgggtgcaagcaggataattcaagctccccaaagccgagctcagtgtttcgtaacggatttagcggtatcaaaaaaccttggcacaggtgtcacgtctgcaatcatcatttccagtttaagcagcacctcagagaccacatgaacacacatacaaatcgtcggccatattcatgtcggatctgtaggaagagctatgttagacctgggagtctctccactcacatgaagctccaccatggggaaaatcgactcaagaaactcatgtgctgcgagttttgtgccaaagttttcgggcatatccgagtttatttcggtcacttgaaggaagtccaccgagtggtcataagcacagaacctgcccctagtgaactccagccgggagatattcccaagaatagagacatgtctgttaggggcatggagggatctctggagcgcgagaataaaagcaatctggaagaagattttttactcaatcaggcagacgaagttaagctgcaaatcaagtgtggacgctgccagatcaccgcgcagtccttcgctgaaatcaaattccatctcttggacgtgcatggcgaggagatcgaggggcgtctgcaggaaggaacttttccgggatccaaagggacgcaggaggagctcgtacagcatgcgtctcccgactggaagcgccaccctgaacgaggcaaaccagagaaagttcatagctccagcgaggagagccatgcctgcccccgtctaaaaagacagttacacctgcaccaaaatggggtagaaatgttgatggagaatgagggcccacagtccggaacgaacaaaccacgggaaacttgtcagggccctgaatgccctggtctgcatactttccttctgtggtctcattccgggttcaactgtctcctgtgtgcagagatgctaggccgaaaagaagatttacttcaccattggaaacatcagcacaattgcgaagatccgtctaaactgtgggcaattctaaatacagtttctaaccaaggagtaatcgagctcagcagtgaggccgagaagtag

SEQ ID NO: 25308 - DNA, 2487 bp, Artificial Sequence
  Description of Artificial Sequence: Synthetic coding sequence
atgcaaaattcagttagcgttccaccaaaagacgaaggtgaatcaaacataccaagcggaaccatccagagccgcaaaggcttgcaaaacaagagtcagttccggaccatcgccccaaagatcgttcccaaggtgttgacctcaaggatgcttccctgtcactcccccagccgctcagaccaggtcaacctggggccatcaatcaatagcaaacttctaggcatgtcaacccagaactacgcactcatgcaggtggccggacaggaggggacctttagtttggtcgccctgcctcatgtggcttctgcacagcctatccagaaaccacgcatgagtctgcccgagaacctaaaattaccgattcccagataccagcctcccaggaattcaaaagcaagccgcaaaaagcccattctcatcttcccgaaatcaggctgttctaaggctccagctcagacgcagatgtgtccacaaatgagcccgtcccctccacaccatcccgaattgctgtataagccgagtccctttgaagaagtgccgagcttggaacaagctccggctagtatcagcactgcagccttgactaatggttctgatcacggtgatctgaggcctccggtcaccaatactcatggcagtctgaacccccctgccacccctgcctcaagcacgcctgaagagcctgctaagcaggatttgacagcactaagcgggaaggctcattttgtgtcgaagattacttctagcaaacccagcgccgtagcgagcgagaagttcaaggaacaggtcgatctcgcaaagactatgactaacctgtccccgaccattcttgggaatgccgtgcaattgatttcatcagtccccaagggcaaacttcccatcccaccatattctagaatgaagaccatggaggtgtataaaataaagagcgatgccaatatagcgggtttttcgcttcctggacccaaagctgactgtgacaaaattccatccaccacagagggttttaacgctgcaactaaagtggcaagccgcttgccagtaccgcaggtcagccagcagtccgcatgcgagagtgcattttgtccccctacaaaactggacttaaaccacaagacaaagctcaactcgggggctgctaagcgaaagggcagaaaacggaaggttcctgacgaaatcttagcattccagggtaagagacggaagtacataattaataaatgtcgagatgggaaggagagggtgaaaaatgacccccaggaattcagagaccagaaactggggacactgaagaaataccggtccatcatgccaaaaccgattatggtcattcctacactggcttctcttgcctctccaactaccctgcagagtcagatgttgggtggtctggggcaagacgtgcttcttaataactcactgactcccaaatatctgggctgtaagcaggacaatagctcaagccccaagccctcctcagtgtttagaaacgggtttagcggcattaagaaaccttggcatcgctgccacgtatgcaatcaccactttcagtttaagcagcacctgagagaccacatgaacacacacaccaaccggagaccctactcttgtcgcatatgccgcaagtcttacgttcgacctgggtcgctgtccacccacatgaagctacaccacggtgaaaaccgccttaaaaagctgatgtgttgcgaattctgcgccaaagtgttcgggcacattcgagtttatttcggacatttgaaggaggtgcatcgtgtggtaattagcacagagccagctccttcagaactgcagccaggcgatataccaaaaaaccgagatatgtctgtacgcggaatggaaggctccctggaacgggaaaacaaaagcaatctggaggaagattttttactgaatcaggcggacgaagtgaaattgcagataaagtgtgggcgttgtcaaattactgcccagtcctttgcagaaatcaagttccatctgctagatgtacacggcgaggagatcgaaggtcggctgcaggagggcactttccctggatctaagggcactcaagaggagttggtgcagcatgccagccctgactggaagcggcaccccgagaggggaaaacctgagaaggtgcatagctcctcggaagagagtcacgcctgcccaagactgaaacggcaacttcacctgcaccagaacggcgttgagatgctgatggaaaacgagggcccacagagcgggacgaataagccacgcgaaacctgccaagggcctgagtgtcctggacttcacacctttctgttgtggtcccactccgggttcaactgtctgctttgcgcagagatgctagggaggaaagaggatctattgcatcattggaaacatcagcacaactgtgaagaccctagcaagttatgggctatccttaacactgtgagtaatcagggcgtgattgaactatcgtcggaggctgagaagtag

SEQ ID NO: 25309 - DNA, 2457 bp, Artificial Sequence
  Description of Artificial Sequence: Synthetic coding sequence
atggactcggagagcaacatacccagtgggaccattcagtctaggaaggggctgcaaaacaaatcccaatttcgtacgattgctcctaagattgtccccaaggtgttgacctctagaatgctgccgtgccactctcctagccggtcagatcaggtcaatctgggcccttcaataaattccaaacttctgggaatgtctacccagaactatgccctcatgcaagtagccggacaagagggcacattcagtcttgttgcgctccctcatgtggcgagcgcccagcctatccagaagccgagaatgtcattacccgaaaacctcaagctgcccatccctcggtatcagccgccaagaaatagcaaggccagcagaaaaaaacctatcttgattttcccaaagtctggctgctcgaaagcacctgctcaaactcagatgtgcccacaaatgtccccttcccccccacatcatcctgagctgctgtacaagccgtcaccattcgaagaggtaccttctttggagcaggcccctgccagcatctccaccgccgctctgacgaatggctccgatcatggtgatctgcggcctcctgtgacgaacacccacggaagcctgaacccccctgcaaccccagctagtagtacacctgaggaacctgcaaaacaagaccttaccgcgctctcaggaaaggcgcacttcgtatcaaagatcacttccagtaaaccctcggccgtagcaagcgaaaagttcaaagaacaggtagacctggcgaagaccatgaccaacctgagtcctacgattctgggtaatgcagtccagcttatttcctctgtcccgaagggcaaactccccatcccaccttattcgcgcatgaagacgatggaagtctataagatcaagtcagatgccaacatcgctggcttttctcttcccggaccgaaagccgattgtgacaaaatcccctctactactgaaggctttaatgccgctactaaggtggcatcccggctgcccgtgcctcaggtatcccagcaaagcgcgtgcgagtccgcattctgccccccaactaaacttgatctgaatcacaagaccaaactaaactctggagccgcaaagcgtaagggcagaaagaggaaggtgcctgatgaaatcctggctttccagggtaagcggaggaaatacattattaataagtgtagagatggaaaagagcgggtgaagaacgaccctcaagaattcagagatcaaaaacttggcaccctgaagaaatacaggtctataatgccaaaaccaatcatggtgatccccaccctcgccagtttggctagcccgactacccttcagagccagatgctcgggggtctcggccaggatgttcttctaaacaacagtttaactccaaagtatctcggttgcaaacaggataactcaagcagcccaaagccttcctctgtgttccgcaatggcttcagcgggattaagaagccctggcatcggtgtcacgtgtgcaatcaccactttcaattcaaacagcacctgcgtgatcacatgaacacccacaccaaccgcaggccttattcttgcaggatttgtaggaaatcatacgtaaggccaggatcactgtcaactcacatgaagctgcaccatggtgagaacaggctaaaaaagttaatgtgttgcgagttttgcgcaaaggtgtttggccacatccgtgtgtactttgggcatttgaaggaagtccaccgcgtggtgataagcactgaaccagccccaagcgagctgcaacccggagatattcccaagaaccgtgatatgagtgtcagaggtatggagggttctctggagcgggaaaacaagtcaaatcttgaagaggacttcctcctcaaccaggccgatgaagtcaagctccagataaagtgtgggcgttgtcagattaccgcccagtcttttgcagaaatcaaattccacctgctggatgtacacggagaggagattgagggacggttgcaggaaggaacttttccagggtctaaggggacacaggaggaattagtacagcatgctagtccagactggaaaagacatccagagagaggcaaacccgagaaagttcattcaagtagcgaagaatcacatgcctgtcctcggctcaagcggcagttacacctgcatcagaacggcgtggagatgttgatggaaaacgaggggcctcaatcagggacaaacaagccccgtgagacctgtcaagggccagagtgcccaggactccacacatttctcctctggtctcactctggctttaactgcctgttatgcgctgaaatgctcggtcggaaagaggacttactgcaccattggaagcaccagcacaactgcgaggatccatcaaagctgtgggccatcctgaatactgtctccaaccagggagtgatagagctcagctccgaggccgagaaatag

SEQ ID NO: 25310 - DNA, 2457 bp, Artificial Sequence
  Description of Artificial Sequence: Synthetic coding sequence
atggactcagagtcaaacatccctagcggcaccatacagtcccgcaaggggctccagaacaagtcccagttccgcaccatcgctcctaagatcgttcctaaggtgctgacctccagaatgcttccatgccacagccctagtcgatctgaccaagtgaacttaggaccaagtatcaatagcaagttgttaggaatgagtactcagaactacgctttgatgcaggtggcagggcaggagggcacattctccctggtcgcactgccacacgtggcttctgcgcagcccattcagaagcccaggatgtctctgcccgagaatctcaagttgccaataccgcgttaccaaccacccagaaattcgaaagcttctaggaaaaagcccattctaatcttccctaaatcaggctgcagcaaggccccagcacagacccagatgtgtcctcagatgtctcccagtccgcctcatcaccccgaactgctgtacaaaccgagcccttttgaggaggttccctccctggaacaggccccagcatccatcagcacagctgcacttaccaatgggagtgatcacggcgatctccggcctcctgtgacgaatactcacggatcactgaaccctcccgctacacctgcctccagcactcctgaggaaccagccaagcaggacctgaccgctctgagcggcaaggcacacttcgtcagtaaaattactagtagtaagcctagcgccgtggcctcagagaaatttaaggaacaggtggacttggccaaaacaatgaccaatctgtcccccacaattctgggtaacgcggtacagctgattagtagcgtgcccaagggcaaacttcctatccctccctattcacggatgaagacgatggaggtgtacaaaatcaaaagcgatgccaatattgctgggtttagcctccccggaccgaaggccgattgcgacaaaattccctctaccactgaaggttttaacgcagccaccaaagtggcaagccgcctacctgtgccacaagttagtcagcagtccgcgtgtgagtccgcgttctgtcctccaactaagctggatttaaaccacaaaaccaaattgaacagcggagctgccaagaggaaaggacgcaagaggaaggtgccagacgagattttagcgtttcagggaaaacgtcggaaatatataattaacaagtgccgggacggcaaagaaagagtaaaaaatgacccacaagaattcagagaccagaaactcggcacattaaagaagtatcgcagtattatgccaaaacccatcatggtcatcccaacgctggcaagtctcgccagtccaaccaccctccagagccaaatgcttggtggcctgggccaagacgtgcttttaaataatagtcttactcctaagtaccttggatgcaaacaggacaactcgtccagtccgaaaccaagtagcgtgtttagaaatggcttcagcggcattaaaaagccctggcacaggtgtcacgtgtgcaatcaccacttccagttcaagcagcacctgcgcgatcacatgaatacccatactaacagacggccatacagctgcaggatttgcagaaaatcatacgtccggcctggctccttaagcacccatatgaagttgcatcacggagaaaaccgtctgaagaaactgatgtgttgcgaattctgtgctaaagtctttgggcacatccgcgtttacttcggccacctgaaagaagttcatcgcgtggtgatttcgacggagccagctcctagtgagttgcaaccaggcgacatccctaaaaatcgtgatatgagtgtacgcggtatggaaggaagcctggaacgcgagaataagtctaacttagaggaggattttctcttaaatcaagctgacgaggttaaacttcaaataaagtgtggaagatgccaaattacggcccagagcttcgctgagattaaatttcaccttctcgatgtccatggcgaggaaatagaaggtcgtctgcaggagggcactttcccagggtcgaagggtactcaggaagagcttgtgcaacacgcaagccccgattggaagcggcaccccgagaggggaaagcccgaaaaagtgcactcaagttcagaagagagccatgcttgcccccgtctgaagcgtcaactccacttgcaccagaatggtgttgagatgctcatggagaatgagggtccccagagtggtactaataagccgagagaaacatgccaggggcctgaatgtccaggtctgcacacgttcctcctctggagtcacagtggctttaattgtttgctgtgtgccgaaatgctgggacgaaaggaagacctgctacaccactggaagcatcagcacaactgtgaagacccctccaaactgtgggccatccttaacaccgtgtcaaaccagggcgttatcgagttatctagcgaggctgagaagtag

SEQ ID NO: 25311 - DNA, 2340 bp, Artificial Sequence
  Description of Artificial Sequence: Synthetic coding sequence
atgctgccttgtcacagcccaagcagatccgatcaagttaacctgggacctagcattaattcaaaattgcttgggatgtccacccagaactatgcactaatgcaggttgcgggacaggaaggaaccttcagcttagttgccttaccacacgtcgccagcgcgcagccgatccagaagcctcgcatgagtttgcccgagaacttgaaactgccaataccaagataccaaccaccacggaattcaaaggcttctagaaagaaacccattctgattttccctaagtctggatgcagtaaagcacccgcacaaacacagatgtgccctcagatgtccccttctcctccacaccaccccgagttactctacaaaccgtcccccttcgaggaggttccctctctggaacaggcaccagccagcatctccacagcggctctgaccaatggatcggatcatggagacctgcgacctccggtgactaacacccatggatccctgaatccccctgcaactccggcaagtagcacaccggaagaacccgcaaagcaagatctcacagccttgagcggtaaggcccattttgtcagtaaaattacaagcagtaagccgtcagccgtcgctagcgagaaatttaaagagcaggtggatttagccaagacaatgaccaatctctctcccacaatactcggcaatgccgttcagcttatcagcagcgtgcctaaaggcaaacttcctattcctccatacagccggatgaagacaatggaggtatacaaaatcaaatcagacgctaatatagccggattttctctgcccggacctaaagccgattgcgacaagatcccatcaactaccgaggggttcaacgcagcaacgaaggtcgcctcaaggctgcccgttccacaagtgtctcagcagtccgcctgcgaatccgcattctgtccgccaaccaagctcgatcttaatcataaaacaaagctgaactcaggcgctgcgaaacgcaagggccgaaagaggaaggtcccagacgagattctggcgttccagggcaaacgtcgcaaatatatcattaataaatgccgggacggaaaagaacgtgtgaaaaacgacccgcaggagtttcgagaccagaagttaggcaccttgaaaaaataccggagcattatgccgaaacccatcatggtgatcccaacactcgccagcctggcctcccctaccacgctgcagtcacagatgctggggggtctgggacaggacgtgttacttaacaatagtctcacaccgaagtacctcggctgtaagcaggataactcttcctctccaaaaccaagttctgtttttcgaaacggcttctccggaatcaagaaaccctggcaccggtgccatgtgtgtaaccaccactttcagtttaaacagcatctaagagaccatatgaacacccacaccaacaggcgtccttacagttgtcgcatatgtcgcaaatcttatgtcaggccaggctcgttgtccacccacatgaagctgcaccacggcgagaaccggctgaagaagctgatgtgctgcgaattctgtgcaaaggtcttcggtcatatcagggtgtactttggacacctcaaagaggtgcatagagtagtgatttctacagagcccgctcccagtgagttacagcctggagatatccccaaaaacagagatatgtctgtccgcggtatggaaggcagtctggaaagagagaacaagagcaatttggaggaggatttcctcctcaaccaggccgacgaggtcaagctgcagataaagtgtgggagatgtcagattaccgcgcagagcttcgccgagattaaattccacctgttggatgtgcacggcgaggaaatagaaggtcggttacaggagggcaccttccccggtagtaaagggacccaggaggaattagtgcagcacgcctcgccagactggaaacggcacccagagcgcggaaagccagaaaaggtacactccagttctgaggaatctcacgcctgccccagattgaagcgtcaactgcatttgcatcaaaacggagtggagatgctgatggagaacgaaggcccacaatccggaaccaacaagccacgcgagacttgccagggtccggaatgccctgggctgcacacgttcctgttatggtcccactcaggattcaactgtctactgtgcgcagaaatgttgggacgaaaggaagacctcctgcatcactggaagcaccagcacaattgcgaagatcctagcaagctctgggccattctgaacaccgtatctaatcagggtgtgatcgaactctccagcgaggcggagaagtag

SEQ ID NO: 25312 - DNA, 1500 bp, Artificial Sequence
  Description of Artificial Sequence: Synthetic coding sequence
atgctaagcctttcacctatcctgctctacacctgtgaaatgttccaggaccctgtggctttcaaggacgtggctgttaatttcacccaggaagagtgggccctgctagacatctctcagaaaaacctgtatcgagaggtcatgttagagaccttctggaacctgacatccatcgggaaaaaatggaaggaccaaaatatcgagtatgagtatcagaatccgcgacgcaactttcgtagtgttacggaagaaaaagtcaatgaaatcaaggaggactcccattgtggagagacatttacacccgtgccagatgaccgtttgaacttccagaaaaaaaaagctagcccagaagttaagtcctgcgacagcttcgtttgcgaagtggggctgggaaattcatcatcaaatatgaacattcgaggcgacaccggtcacaaagcctgtgagtgccaggagtacgggccaaagccttggaagtcccagcagcccaagaaggccttccgctatcatccctctctacgaacacaagaacgggaccacaccgggaaaaaaccctatgcatgcaaggagtgcggcaaaaatatcatttatcactcgtctatccagagacacatggttgtgcacagcggcgatggtccatataagtgcaagttctgtggcaaagcctttcattgtctctcgctatacctgatccacgaaagaacacacactggtgagaaaccttatgagtgcaagcaatgcggaaaatcatttagctactccgctacccaccgcatacatgaaagaacccatatcggagaaaagccatatgagtgccaggagtgcgggaaggcatttcactcaccccgaagttgtcatcggcatgaaagaagccatatgggggaaaaagcttaccagtgtaaggagtgtgggaaagcatttatgtgcccaaggtatgtgcggaggcatgagcggacccactcaaggaagaaactgtatgagtgtaaacagtgtggtaaagccttgtctagtttaaccagctttcagacgcatatcaggatgcacagtggcgagcggccttacgaatgtaaaacttgtgggaaagggttctatagcgccaagagtttccagagacacgagaaaacgcattccggagaaaagccatacaagtgcaagcagtgtggtaaagcatttactcgttctggttcttttcggtaccatgaaaggacccatactggggaaaaaccctatgagtgcaaacaatgcgggaaggcatttcgctcagcccctaatttacagctgcacggccgtacacataccggcgagaagccttaccaatgtaaggaatgtggcaaggcgtttcgctccgcttcccagctgcgcatccaccggagaattcacaccggcgaaaagccctatgagtgtaaaaagtgtggaaaagctttcaggtatgtgcaaaactttcgtttccacgagagaacacagactcataagaatgcactttggcgtaagacattatag

SEQ ID NO: 25313 - DNA, 1788 bp, Artificial Sequence
  Description of Artificial Sequence: Synthetic coding sequence
atggatccagtggcatttaaggatgtggccgttaacttcacccaagaagagtgggctctccttgatatatcccagcgtaagctttaccgcgaggttatgcttgagacatttcgcaatctgacctccctggggaagcgctggaaggaccaaaacatcgaatacgagcatcagaaccccagaaggaatttcaggtctttgattgaggaaaaggtcaacgagattaaggatgactcccactgtggggagacatttacacccgtacctgacgatcgattgaattttcaggagaagaaagctagccctgaggtgaagtcatgtgagagcttcgtctgtggtgaggtcgggttgggaaatagttctttcaacatgaacataagaggggacatcggccataaagcgtatgagtatcaggagtacggaccaaagccctgtaagtgccaacagcccaaaaaggctttccggtatcgaccgagcttcaggacccaggagagagaccacactggagagaaacctaatgcgtgtaaggtgtgtggcaagacttttatttctcacagtagcgtgaggcggcacatggttatgcattctggggatggtccatacaaatgcaagttttgcggaaaagcttttcactgtttacgcctctacctgatacacgaaagaattcatacgggagagaagccctgtgagtgtaagcagtgtggtaagtccttttcctattctgcaacccaccgcatccataagcgcacccatactggtgagaaaccgtacgagtaccaagagtgtggtaaggcctttcactcccccagaagctatcggcgacacgagaggattcatatgggcgaaaaagcctaccagtgtaaagaatgcggcaaggccttcacatgtcccagatacgtgcgcatccatgagcgcacccacagccggaagaacctgtatgagtgcaagcaatgcgggaaggctctgagtagcctgacaagcttccagacccacgtgcgccttcactccggcgagcgaccttacgagtgcaagatctgtggaaaagatttttgctcagtgaactctttccagaggcacgagaagatacactctggcgaaaagccctacaaatgcaagcagtgtggtaaggccttccctcactcctctagcctgagataccacgagcgcacccatacaggcgaaaaaccttatgaatgtaagcagtgcgggaaggcgttcaggagcgcatctcacctgagagtgcacggacgaacacacacgggagagaagccttatgaatgtaaagagtgtggaaaagccttccgctacgtcaacaatctgcagagccacgagcgcactcaaacacacatcaggattcacagtggggaacggcgatataagtgcaagatttgtggaaagggcttttattgccctaaatccttccaacggcacgaaaagacacataccggcgaaaaactttatgagtgtaagcagcgaagtgtagtacctagtgttgtgcccgttcccttcgatattatgaaaggattgaccctcgagcggagcccgatcaatgccagtaacgtgggaaagccaagtgagctatgtcaaagcttcgaatgcatggtgggccttaccctgaagagaaacccgatgagcgtgtcaaatgacggaaagccatctgacctgcctcacacttttgagtatgtggttggacacaccatggaaagaagccccatgcacgtcaggaatgtcggaaaccccagtgatctcccgcgtacattcgaattcatgaaaggccacaagcatacatag

SEQ ID NO: 25314 - DNA, 2082 bp, Artificial Sequence
  Description of Artificial Sequence: Synthetic coding sequence
atggacagcgtggcttttgaagacgtggctattaacttcacttgcgaggagtgggcactcctcgggcctagtcagaagagtctgtacagggatgtgatgcaagagaccattcgcaacctggattgcattggcatgatctggcagaaccatgacattgaggaggaccagtacaaggacctacgtcgaaacctgcggtgccacatggtggaacgcgcttgcgaaatcaaggacaactcccagtgcggtggaccattcacacagacccaggacagcatcgtgaacgagaagattcccggagtggacccgtgggagagtagcgaatgcacagatgtgctgatggggaggtcctcactgaactgctacgtgcgggttgactcagagcataaaccgtgtgaataccaggaatacggtgagaaaccttatacccacacccaatgcggcactgcttttagctaccaaccgtgttttcaaatccatgagcgcccacagcatggcaagaagctttacgactgtaaggaatgtgcgtccttcagcagtctggaaaatctgcagagacacatggcagcccaccacggtgatggccctcgtatctgtaagctgtgcggaaacgcattcatatggccttctttgttccacatgctgcgcagaacacacaccgaggagaagccctacgaatatgaacagtgctcgacggcttttcccgcttactcatccaccctgcgccacgaacggacacacagcggcgagaagccctaccagtgcaagcagtgcggcaaagcattctcttgttcttgttacacgcagctgtacgagcgcacacacactggtgagcagtcttatgaatgcaaacagtgcgggaaggcattctaccacttaggttccttccagagacacatgatcgtacacacaggggacggccctcataaatgtaaaatctgtggaaaaggtttcctatctcccagttccgtgaggcgacataagcgtacgcacactggcgagaagccctacgaatgcaagtattgcggaaaagccttcagcgactgtactggttttcggaggcacatgattacccacaccggtgacgggcctcataagtgcaaagtgtgcggaaaggcttttgattctcccagcctgtgcagacggcacgaaactacgcataccggtgagaagccctataagtgcgagtgcggtaaagccttctcggacttctactacttccggaatcatgagactacacacacaggggaaaaaccttacaagtgcaagcagtgcggaaaggctttcatctgctgcacgtatttacagattcacgagaggattcacactggggagagaccttataaatgcaagcaatgcggtaaggccttcaggtcaagcaactatatccgcgtccacgaaaagacccacacgggtgaaaaaccttatgagtgcaagcagtgcgggaaagccttgagccacctgaagtcctttcagcgtcatatgataatgcacactggggatgggccacataagtgcaaaatttgtgggaagtcctttgattcccctagtagctttaggaggcatgaaaggattcatacaggtgaacgtccgtataaatgcaaactatgtggaaaaggtttccgaagcagttcctacatacaactccacgaacggacccacactggcgagaagccgtatggatgccaacagtgtggcaaagcgctgtcagatctgagcagctttagacggcatatgattactcatactggcaacggaccccacaagtgtaaaatttgtggtaaaggctttgactatccaagttcagtccagagacacgaacggacacacaccggtgagaaaccatatgaatgcaaggagtgcggaaaggcgttctcccacagttcgtatctccgcattcatgagagggtccacacaggcgagaaaccctataaatgtaaagagtgcggcaagccctttcactgtcctagcgcatttcacaaacacgagcggactcatagcatggagaagccctacaaatgcaaagagtgcggagaggcattccattgcatcagctccttccataaacacgaaatgacgcactag

SEQ ID NO: 25315 - DNA, 1881 bp, Artificial Sequence
  Description of Artificial Sequence: Synthetic coding sequence
atggtcgaaagggcctgcgaaattaaggataactcccagtgtggagggccattcacccagacacaggactctattgttaacgagaagattccgggagttgacccttgggagtcctcggagtgcaccgatgttctgatggggagatctagcctgaattgctacgtgcgcgtggactctgagcacaaaccctgtgagtatcaggagtacggcgagaagccttatacccacacacagtgcggcaccgcgttcagctaccagccatgcttccagattcacgagaggccccaacacggcaagaagctgtacgattgtaaggagtgtgcgtctttcagctcactcgaaaatctccagcgccacatggctgcgcatcatggcgatggacccaggatttgcaagctttgcggaaacgccttcatttggccgagtctgttccacatgctacggcgtactcacacagaagaaaaaccttatgagtacgagcagtgctcgaccgcttttccagcatattctagtactctgcggcatgagcggacgcacagtggagaaaagccttaccagtgcaagcagtgcggcaaggccttttcttgttcatgttatacacagctctacgaacgcacgcacacgggtgagcagtcttacgaatgcaagcagtgcgggaaagccttttatcacctgggctcatttcagcgtcacatgattgtacatacaggggacggaccacataagtgcaaaatatgtggaaagggtttcctgtctccgagctccgtccgcagacataaaaggacccacactggtgaaaagccatacgagtgcaagtactgcggcaaagcgttctcagattgcacagggtttagacgccatatgatcactcacacgggggacgggcctcacaagtgtaaagtttgcggcaaagccttcgactcacccagcctttgtcggagacacgaaacaactcacaccggagagaagccctacaagtgcgaatgcggaaaggcattcagcgatttttactactttcgaaaccacgagaccacacataccggtgagaaaccttacaaatgtaaacagtgcggcaaagcattcatttgctgtacctatttgcagatccacgagcgaatccacactggcgaacgaccttacaaatgtaagcagtgcgggaaggccttccgtagctctaactacattagggtgcatgaaaaaactcacacaggcgagaagccttatgagtgcaaacagtgtggaaaagctctgagccatttgaaaagttttcagcgacatatgattatgcacaccggggacggcccacacaagtgtaagatttgcgggaagtcattcgatagcccgtctagtttccgtaggcatgaaaggatccacacaggggaaagaccttataagtgcaagctctgtggaaagggatttcggtcgtctagctatatccaactgcacgagagaactcacactggcgaaaagccctatgggtgtcaacaatgcggcaaggcccttagtgatttgtcttcattccgtaggcacatgattacacacactgggaacggccctcataaatgcaaaatctgcggtaaggggtttgactaccctagctccgtgcagagacatgagagaacacacaccggtgaaaagccttacgagtgcaaggaatgtgggaaggctttttctcactctagctacctgaggattcatgagcgcgttcacaccggcgagaagccatataaatgtaaggagtgtgggaaacccttccattgcccctctgcatttcacaaacacgagcgtactcattccatggaaaagccctataaatgcaaggagtgcggcgaggcatttcactgcatttcatctttccacaaacatgaaatgacacattag

SEQ ID NO: 25316 - DNA, 1884 bp, Artificial Sequence
  Description of Artificial Sequence: Synthetic coding sequence
atgatcgtgtttggtggtgaggaccgctctgatcttttcctgccagacagtcagacaaacgaggagcgtaaacagtatgattcagtcgcatttgaggatgtcgcggtgaattttactcaggaggaatgggcactgctggggccaagtcaaaagagtctctatagggacgtaatgtgggaaacaatacgcaatctcgactgcattggcatgaagtgggaggataccaatatcgaggaccaacacaggaatccccgacggtccctgagatgccacatcatagagaggttcagcgaatctcgccagcccgattccactgtcaacgagaagcctcccggtgttgatccatgtaagagcagcgtctgcggcgagatcatggggtgctcatttctcaactgctatattaccttcgacgctggacacaaacccgatgagtgccaggaatatggcgaaaagccccatacccataagcagtgcggaaccgcgttcaattatcaccacagttttcagactcaggaacggccacacactggtaagaagaggtacgactgcaaggaatgcgggaaaacattttcctcttctgggaatctgcgccgacacatcattgtgcagcggggaggtggaccatatatatgcaaactgtgcgggaaggctttcttctggccatctctgtttagaatgcatgagagaacacacaccggcgagaagccttatgagtgtaagcagtgctgtaaagcatttccaatctactcctcctatctccggcatgagcggactcacactggcgaaaagccttacgagtgtaagcattgttccaaggcatttcctgattattctagctatgtgcgccacgaacggactcataccggagaaaaaccatataaatgtaaaagatgtggccgtgccttctccgtttccagctctcttcgcatacatgagagaacacacacaggcgagaaaccgtacgagtgtaaacaatgtggtaaagccttccaccatttgggctccttccaacgccacatgattcgccacacaggcgatggacctcataaatgcaagatttgtggcaaaggcttcgattgcccgagctcactgcagtctcacgagcggacccacacgggagagaagccatacgagtgcaagcagtgtggtaaagcactgtcccaccactcttcgttccggtcacatatgatcatgcataccggtgacggccctcacaagtgcaaggtgtgcggcaaagccttcatctatccctcggtgttccaggggcatgaacggactcacacgggtgagaaaccttatgagtgtaaagaatgcgggaaggccttccgtatctccagcagcttaagaaggcatgagaccactcacaccggcgaaaagccctataagtgcaaatgcgggaaggcgtttatcgacttctactcctttcagaatcatgagaccacccatacgggagagaaaccctacgagtgtaaagagtgcggcaaggccttctcttgcttcacctatctttctcagcatcgacgaacacacatggcagagaaaccctatgaatgtaagacctgcaaaaaggcctttagccacttcggaaacctcaaagtccatgagagaattcacacgggtgaaaagccttatgagtgtaaggagtgtcgcaaggcattctcctggctgacgtgcctgctgaggcacgaacgaatccacaccgggaaaaaatcatacgagtgccagcagtgtggaaaggccttcactagaagtcgctttctccgcggacacgagaaaacccatactggggaaaaaatgcacgagtgcaaggaatgtggtaaggcccttagctcactgagttccctccatcgccacaaacgaacccactggcgggacaccctctag

SEQ ID NO: 25317 - DNA, 1677 bp, Artificial Sequence
  Description of Artificial Sequence: Synthetic coding sequence
atgaaatgggaggacaccaacattgaagaccagcatagaaacccacgacgctccctcaggtgtcatattatcgaaaggttctcagagagtcgacagccagattccactgtgaatgagaagccacccggtgtggacccatgtaagtcatccgtctgcggtgaaatcatgggatgcagttttctgaactgctacatcacttttgacgcagggcataagccagatgagtgccaagaatacggtgaaaaacctcatactcacaaacagtgcggtactgcctttaactatcaccactccttccagacccaggaacgccctcacacagggaaaaaacgctacgattgtaaagaatgcgggaagactttctcctcttcagggaacctcaggagacatatcatcgtgcaaagaggcggaggaccttatatttgtaagctctgtggcaaggcctttttctggccctccctattcaggatgcacgagaggacacatacaggcgagaaaccctacgaatgtaagcagtgctgcaaggctttccccatctacagctcttatctacgacatgagagaactcataccggcgaaaagccttacgagtgtaaacactgctcaaaagcattccctgactatagctcctacgttcgccacgaacggactcatactggagaaaaaccatataaatgtaagcggtgcggcagggcgttcagcgtaagctcatcactccggatccacgagagaactcataccggggagaaaccctatgaatgtaagcagtgcgggaaggcattccaccatctgggaagcttccaaagacatatgatcaggcataccggcgatgggcctcataaatgcaagatttgcgggaagggatttgactgcccctcatctctgcaatcccacgagcgtacccacaccggagaaaaaccctatgaatgtaaacagtgtggtaaagccttgtctcatcattctagctttaggagtcatatgattatgcatacgggtgatggaccgcataaatgtaaggtgtgcggtaaggcgttcatctatcccagcgtgtttcaggggcatgaacgaacccacaccggcgaaaagccgtacgaatgcaaagagtgtggaaaggcttttcgaatttcctccagcctgaggcggcatgagacaacccatactggggagaagccttacaagtgcaagtgtggaaaagcattcattgatttttattcattccagaaccacgagacaacacatacgggggaaaaaccttacgaatgtaaagaatgtggaaaggcattttcctgcttcacatacttgtctcagcaccgacgcacccatatggcagagaaaccttatgaatgcaagacttgcaagaaggccttttcacacttcgggaacctcaaggtacacgaacgcatccacactggtgagaagccctatgagtgcaaagagtgtcggaaggctttcagctggctcacttgtctcctgagacacgaacgtattcacactggaaagaaaagctacgagtgtcaacaatgtggcaaggcatttacgagatcaagatttttgcgtgggcatgaaaagacgcacacaggagagaagatgcatgagtgtaaggagtgtggtaaagccctgtccagcctctcttccctccacagacataagcggacgcattggcgtgacaccctctag

SEQ ID NO: 25318 - DNA, 2016 bp, Artificial Sequence
  Description of Artificial Sequence: Synthetic coding sequence
atggcatccgtggccttagaagatgtagccgttaacttcactcgggaggaatgggccctgttaggcccatgccaaaaaaacttgtacaaggacgtgatgcaagagacgatacggaatcttgattgtgtggtgatgaaatggaaagatcagaatattgaggatcagtaccggtacccacgcaaaaacctcaggtgtcgcatgcttgagaggttcgtcgagtccaaggatggcactcagtgcggtgagacatcatcacagattcaggattcaattgtgacaaaaaacactctgccgggagttgggccatgtgaatcgtctatgcgaggcgagaaggtgatgggacattcttcgttaaactgttatattcgcgtcggagcaggacacaagccgcacgaatatcacgaatgcggcgaaaaacccgacacacataagcagagaggcaaagccttctcgtatcacaatagtttccagactcatgagcggttgcacaccggcaaaaagccctatgattgcaaagagtgcggaaaaagcttttcctcactggggaacttgcagaggcatatggccgtccagcgaggggacgggccatataagtgcaaactgtgcggcaaagcctttttctggccgagtttactgcatatgcatgaacgcacccacacaggggaaaagccctatgagtgcaagcaatgctcaaaggccttttcattctactctagctacctgcgtcatgaaagaacacatacaggcgaaaaaccctacgagtgcaagcaatgcagcaaagccttccctttttattctagttacctgagacacgaacggactcacactggcgaaaagccttataaatgcaagcagtgcagcaaggctttccctgacagttcctcgtgcctcatccacgaacgcacccatacgggcgaaaaaccttatacttgcaaacaatgcgggaaggctttctccgtgagcggtagtctgcaaagacacgagacaactcactctgctgaaaagccatatgcttgccagcagtgtggcaaggctttccatcacctgggatccttccaaagacacatgatccgccacaccggcaacggtccacataagtgcaagatttgtggaaaagggttcgactgcccctcaagcctccagagccatgagagaacgcatacaggtgagaaaccctatgagtgtaagcagtgtgggaaggccctctcccataggagttcatttcgcagtcatatgattatgcacacaggagatggcccacacaaatgtaaagtgtgcggcaaggcatttgtttatccatcagtgtttcaacgacatgaaaggacccacaccgccgagaagccgtacaagtgtaaacaatgcgggaaagcatacaggataagtagctcactcagacggcatgaaacaacccataccggcgagaagccttataaatgcaaactcgggaaagcctgtattgacttttgctcattccagaaccataaaaccacacataccggagagaagccctatgagtgtaaagaatgtggaaaggccttctctaggttcagatatctgagtcggcataaacggacccatactggtgaaaagccatacgagtgtaagacgtgccggaaagcatttggacactacgacaacctgaaagtgcacgaaaggatccatagcggggaaaagccctacgaatgtaaggagtgtgggaaagccttctcgtggcttacttgcttcctgcgtcatgagcgcatccacatgcgcgagaagtcttacgaatgcccacagtgcggaaaggcctttacccactcacgcttcctgcaggggcacgaaaagactcacaccggagaaaacccttacgagtgcaaagaatgcgggaaagcatttgcctcactgagttccctgcaccggcacaagaagacacattggaagaagacccacaccggcgagaatccttatgaatgcaaggaatgcgggaaggcgtttgcttccctgagctcattgcaccggcacaaaaagacgcactag

SEQ ID NO: 25319 - DNA, 1932 bp, Artificial Sequence
  Description of Artificial Sequence: Synthetic coding sequence
atggcctccgttgctcttgaggacgttgccgtaaactttacccgagaggagtgggcattattgggaccctgccaaaagaacctgtataaagacgtcatgcaggagactataagaaaccttgactgcgtcgtgatgaagtggaaagatcaaaacatagaggatcaatatagatacccgagaaagaatctgagatgccggatgctggaaagatttgtggagtccaaggacggcacccagtgtggggaaactagcagccagatccaggattctattgtcaccaaaaacaccctccccggagtgggaccgtgcgaatcttcaatgcggggagagaaggttatggggcactcatctctcaactgctacatacgggtgggggctgggcacaagccacacgagtaccacgagtgtggggagaagccagatacccacaaacagcggggaaaggccttttcctaccataatagctttcagacccatgaacgccttcacacagggaagaagccatacgattgtaaagagtgtggaaagagtttctcaagcctgggcaatctgcagaggcacatggcagtgcagcgcggagatggtccttataagtgcaagttatgtggaaaggctttcttttggccgagtctgctgcatatgcacgagcgtacacataccggagaaaaaccatatgagtgtaagcagtgctcaaaagctttctccttttacagcagctacttaaggcatgagcgcacgcacactggtgagaaaccttacgagtgcaagcaatgtagcaaagccttcccgttttatagcagttacctgaggcatgagaggacccacaccggggaaaagccatacaaatgcaagcaatgctcaaaggcattcccagatagctcgtcttgtctgatccacgaaaggacacacacaggggagaagccctacacatgcaagcagtgcggcaaagccttttccgtgagtggcagtctacagcgacacgaaacaactcattccgccgaaaaaccatacgcatgtcaacaatgtggcaaagccttccatcacttaggctccttccagaggcacatgatcaggcatactggaaacggccctcacaagtgcaaaatttgcggaaagggattcgactgcccctcttcactacagagccacgaacggacccataccggcgaaaaaccttacgagtgcaaacaatgtgggaaagcactgagccaccgatcatctttccgatcccatatgattatgcacacaggggacggtcctcataaatgtaaggtgtgcgggaaggctttcgtctatccaagcgtcttccagcgccacgagcggacccataccgcagaaaaaccctataaatgcaagcagtgtggaaaggcataccggatcagttcctcactgcggcgacacgagacaacacacactggggagaaaccctacaaatgtaaactagggaaagcctgtatcgatttctgcagtttccagaaccacaagactacacacaccggagagaagccatacgaatgtaaggagtgcggaaaggcgttcagcagatttcgctatctttccaggcacaaacgtactcacacaggcgagaagccttacgaatgcaagacgtgccggaaggctttcggccactatgataacctcaaggttcacgaacgcatccatatgcgagaaaagagctatgagtgtccccaatgcggtaaggcgtttacacacagtcgattcttgcagggccacgaaaagacgcacaccggcgagaacccctatgaatgcaaagagtgtggaaaagctttcgcgtctctatcgtccctacatcggcataaaaagacacactggaagaaaacacacacgggggagaatccctacgaatgcaaagagtgtggtaaggccttcgctagcttgtcgagtttgcaccggcacaagaagacccactag

SEQ ID NO: 25320 - DNA, 1053 bp, Artificial Sequence
  Description of Artificial Sequence: Synthetic coding sequence
atgcccccaggccgatggcatgccgcaagcagtggaccagtgtttgagggggcacgtctgcagactgtgaagaaagaggaggaagatgaatcatacacacctgtgcaagctgcgaggcctcagaccttgaatcgtccaggccaggagctctttcgacagctgtttaggcagctccgatatcatgagtcatccggcccactggagacgctaagccgcctcagggaactgtgcaggtggtggttaaggcctgacgtgctttcgaaggcccagatcctcgagttattagtcctagaacagttcctatccattctgcctggggagttacgggtctgggtgcaactgcataacccggaaagtggagaagaatggccttgctggcgttcctgtcgagggactcttatggggcaccccggtggaacacgggcacctgagcctcgctgtgcccttgacggctatcggtcaagatctgctcagatttggtcactcgccagtcctctgagatcgtccagcgcccttggagaccatctcgagcctccctacgagatcgaggccagagactttctggcaggccagagcgacactcctgctgcccagatgcccgcattgtttccacgagagggatgccctggcgatcaggtcacacccactaggagcctcacagcccaactgcaggagactatgacatttaaggacgtggaggtcacgttttcacaggatgaatggggatggctcgatagcgcccagaggaacctgtaccgagatgtgatgttggaaaactatcggaacatggcttccttggtcgggccttttactaagccagcactcatttcttggcttgaagcaagagaaccatggggtttgaatatgcaggctgcccagcccaagggaaatccggtggccgcaccgacaggcgatgatctgcagagcaaaacaaataaatttatcttgaaccaggagccactagaggaagcggaaacgttagctgtgagttctggatgcccagccacttcagtgagcgagggtattggcctgagggagtccttccagcaatag

SEQ ID NO: 25321 - DNA, 3096 bp, Artificial Sequence
  Description of Artificial Sequence: Synthetic coding sequence
atgccaccgggtcgctggcacgccgcttaccctgcccaggcccagtccagcagagaacggggacggctccagactgtgaaaaaagaagaggaggatgaatcatacactcccgtgcaggcagcccgaccacagactctgaatagaccaggccaggaactgttcaggcagctattccgtcagctgcgctaccacgagagttccggtcccctggaaacactttcccgtctgcgggaactgtgtcgctggtggcttcggccagacgtgctgtctaaggcgcagatactagaactgttggttctggagcagttcctgagcattctcccaggtgaactgagggtctgggtccagctacacaatcccgaaagtggagaggaggccgtggcgcttctggaagagcttcagagggacctggacggaacctcttggagagaccctggccctgctcaatctccagatgttcattggatgggtactggggctttgagatctgcacagatctggtctcttgcgagtccgctgcgctcctcgagcgccttaggcgatcacttggagcccccttacgagattgaggctagggatttcttggcaggccaaagcgacacacctgccgctcagatgcccgctctgttcccacgcgaagggtgtcccggtgatcaggttaccccaacgcgttctctgaccgcgcagctccaggaaacgatgaccttcaaggatgtcgaagtgaccttttcccaggacgagtggggttggctggattctgcgcagcggaatttataccgggatgtaatgctggaaaactatcgcaatatggcgtctctggtaggaccattcaccaaacccgcactgataagttggctggaagccagggagccatgggggctgaatatgcaggctgcccagcccaagggcaatcccgtggccgctcccacgggagacgatctccaatcaaagactaacaaattcatcttgaaccaggagccgcttgaggaggccgagaccttagccgttagttcaggttgtcccgcaactagcgtgtccgagggtatcggcctaagggagtctttccagcagaagtcacggcaaaaagatcaatgtgagaacccaattcaagtcagggtaaaaaaagaagagactaatttctcccaccgaaccgggaaagattccgaggttagtggaagcaattccttagatctaaaacacgtgacttacctgcgtgtgagcggtcgcaaagaatctttgaagcacggttgcggaaagcattttaggatgtcgagtcaccactacgattacaagaagtacggcaagggtctacgccatatgattgggggttttagcctccatcagcgaatacacagcggactcaaaggaaacaagaaagacgtctgtggaaaagacttcagcctatcatcacaccatcagcggggacaaagcctgcacacagtcggcgtgtcattcaagtgttccgactgtggtcgcaccttttcgcatagttcacacctggcttaccaccagaggctccacacccaagaaaaagcctttaagtgccgggtgtgcggcaaagcatttcgctggagctccaattgcgccagacacgagaagatccacacgggggttaagccatacaaatgcgatctatgcgaaaaggctttcaggcgattatccgcatacagattgcaccgcgagacgcacgctaagaaaaaattcctggagttgaatcagtatagagctgcactcacctactcatccggtttcgatcaccacctcggcgatcagagtggcgagaagttgtttgattgcagccagtgcaggaaaagcttccactgtaaatcgtacgtgttggagcaccagaggatccacactcaggagaagccatataagtgtacaaagtgtagaaagactttcaggtggaggagtaacttcacaagacatatgcgactacatgaggaggagaaattttacaaacaggacgaatgtagagaggggttccggcagtccccagattgctctcagccacagggcgctcccgctgtcgagaaaactttcctctgtcagcagtgcggaaagacattcacgcgtaaaaaaacgcttgtggatcatcaaagaattcacaccggggagaagccctatcagtgtagcgactgtggtaaggacttcgcctatcgttcggccttcattgtgcataagaagaagcacgccatgaaacgcaaaccagaaggaggtccttccttctcgcaggatactgtttttcaagttccacagagtagccactctaaagaggagccgtacaagtgctcgcagtgcggcaaggcttttagaaaccacagttttctgctcattcaccaaagggtgcatacaggtgaaaaaccatacaaatgtcgtgagtgcgggaaagccttccgctggagcagcaatctgtatagacaccagaggattcacagtttgcagaagcagtatgattgtcacgaatctgaaaagacaccaaacgtggagcccaagatactcactggcgagaaacggttctggtgtcaggagtgcggcaagaccttcactaggaagagaacccttttggaccacaaggggattcacagtggagagaagagatacaagtgtaacctgtgtggcaagtcatatgataggaattatcgtctggtgaaccatcagcgcatccactccacagagagacccttcaagtgtcagtggtgtggaaaggagtttattgggcgtcacacactatcctcccaccaaaggaagcataccagggctgcccaggcagaacgcagcccaccagcccgatcatccagccaggacaccaagctgcggctccagaagctgaaaccatcggaggaaatgcctctcgaggattgtaaggaagcctgcagccagtcgtcgaggttgactggattgcaggacatctcaatcggcaagaaatgccataagtgcagtatctgcgggaagacgtttaataagagcagtcaactgatttcacacaagcgctttcacacccgggaacgacccttcaaatgctcaaaatgtggaaaaaccttccgctggagctccaacttagcacgacacatgaagaaccacatcagagactag

SEQ ID NO: 25322 - DNA, 3096 bp, Artificial Sequence
  Description of Artificial Sequence: Synthetic coding sequence
atgccgcctggcagatggcacgccgcttatcctgctcaggcgcaatcttctagggagagaggcagacttcaaacagtgaagaaagaagaagaggatgagtcctacacaccagttcaagccgcaaggccgcagactcttaataggccaggccaggaactgtttaggcagctgttcaggcaactgcggtaccacgaatctagcgggcctttggagactctgagtcgcctgcgggagctgtgtcgctggtggttgcgcccagatgtactatccaaagctcagatcttggaactgctggtgctggaacaatttctatctatcctccctggtgaactgcgcgtttgggttcagctgcataaccccgaatcgggcgaggaagccgttgctcttttagaggaacttcagcgcgacctggatggaacgagctggcgggatcccggtccagcccaatccccagatgtgcactggatgggcacaggagccctgcgatcggcacagatctggagtttggcaagccccttacggagctccagcgctctgggcgaccatctggagcccccatacgaaattgaggcaagggacttcctggctgggcagagcgacactcccgctgcacaaatgcccgcattgtttcccagagagggctgccctggagatcaggtcaccccaacccgctcactgacggcacagctgcaagaaactatgacttttaaggacgtggaagtaacgttctctcaagatgaatgggggtggctcgattcagcacagaggaacctttatagggatgtgatgctggagaattataggaacatggcaagcctggtgggcccattcactaagcccgcactgatctcatggcttgaagctcgagaaccttgggggctcaacatgcaggccgctcagccaaagggcaacccagtggctgccccaactggagatgatctccagtccaaaactaataaatttatcctaaaccaggagccactggaagaggccgaaactttggccgtttcatctgggtgccccgctactagtgtgtctgaaggaataggccttagagagtcattccagcagaaatccagacagaaggatcagtgcgaaaaccccatccaggttcgggttaagaaagaggaaactaacttttcacaccgcacaggaaaagactccgaggtttctggaagcaatagtttagatctaaagcatgtgacttacctcagagtgagcggacggaaagaatctcttaaacacgggtgcgggaaacacttccgtatgtcgtctcatcactacgactacaaaaaatatggaaagggacttcgacacatgattggaggctttagcctgcatcagcgcatccactctgggctgaaggggaataaaaaggatgtgtgtggtaaggacttctcactgagttcccaccaccaacgcggtcagtcactccacacagtgggggtaagctttaagtgtagcgactgcggcagaactttctcccattctagccacctggcttaccaccagcgactgcatactcaagaaaaagccttcaagtgccgagtttgcggcaaggctttccggtggtcaagtaactgcgcacgtcacgagaagatacataccggcgtcaaaccatataagtgtgatctgtgcgagaaggcttttcgacgcctgtccgcctacaggctgcaccgggagacacatgcgaagaaaaaattccttgagctgaaccaatacagagctgccctgacctattcaagtggctttgatcaccacctgggagaccagagcggtgaaaaactatttgattgctcccagtgtaggaagtccttccattgcaagagctacgtccttgaacaccagcggatccacactcaagagaagccctacaagtgcaccaagtgccggaaaacctttcgctggcgatcgaattttacccgacacatgcggctacacgaagaagagaaattttacaagcaggatgagtgcagagaagggttccgacagtcccccgactgttctcaaccacaaggcgctcctgcagtcgagaagaccttcctgtgccagcagtgcggtaagacgttcacccgaaaaaagaccctcgtggaccaccagagaatccacacaggggaaaaaccataccagtgttcagactgcgggaaagactttgcgtatcgatcagccttcatcgtgcacaagaaaaagcacgccatgaaacggaaacctgagggtggccctagcttttcacaagacaccgtcttccaggtaccccaatcatcacacagcaaggaggagccctacaagtgttcccagtgtgggaaagcttttcggaatcacagcttcctgctgattcaccagagagttcacacaggtgagaagccttacaagtgccgtgaatgcgggaaagctttcagatggagttccaacctctataggcaccaacgcatccacagcctgcaaaaacagtatgactgccacgagagcgagaagacacctaacgtagagccaaaaatcctgactggtgagaagaggttttggtgccaggagtgcggaaagacttttacacggaagcgaacactgctggatcacaaggggatccacagcggcgaaaagcgctacaagtgcaacctttgtggtaagagctacgataggaattatcgactagtaaaccaccaacggattcacagtaccgagcgtcctttcaagtgccagtggtgtgggaaggaatttattggccgacatactctatcctcccatcagcgaaagcacacccgggctgcccaggccgaacggtccccaccagcaagaagtagctcccaggacaccaaactccggctgcaaaaactgaagccttctgaagaaatgcctctggaggactgtaaggaagcctgcagtcagtcatcgcgactgacagggcttcaagatataagcattggtaagaaatgtcacaaatgctctatttgcggcaaaacatttaacaaaagtagccagctcattagccataaaagatttcatacgagagagagacccttcaagtgttccaagtgcgggaagacgttcaggtggtcctctaatctggccagacacatgaagaatcatattcgggactag

SEQ ID NO: 25323 - DNA, 822 bp, Artificial Sequence
  Description of Artificial Sequence: Synthetic coding sequence
atgcctcctggcaggtggcacgccgcaatttcaagtggacctgtgtttgagggcgcaagagcacttcagaccgtgaagaaggaagaggaggacgagtcttacacacccgtgcaagctgctcgtccccaaacgttaaatagaccagggcaagagctgttccgacagctgttccggcagctgaggtatcacgaatcaagcggccctctagagacgttgagccggctcagggagttatgtagatggtggcttcggccagacgttcttagcaaggctcagattctggaattgctcgtactagagcagttcctgagtatcttgcccggtgagctccgtgtctgggtccagcttcataaccccgaatctggtgaagagctgtggccatgctggaggtcctgtagggggactctgatgggacatcccggtggtacccgtgctctgccggagcccaggtgtgccctagacggctataggtcactgcgaagtgcccagatatggtccctcgcgagtccactgagatcgagcagcgcactgggggatcacctggaacccccttacgagatcgaggccagagacttccttgccggacagtccgatacacccgctgcacagatgcctgctctctttcccagggagggctgtccaggggaccaggtgacacctacacgcagtctgactgcgcaactgcaggagactatgacctttaaagacgtggaagtcaccttttcacaggatgagtgggggtggctggattcggcccaacggaacctctaccgcgacgtcatgttggagaactacaggaacatggcctcccttggtaagtag

SEQ ID NO: 25324 - DNA, 1353 bp, Artificial Sequence
  Description of Artificial Sequence: Synthetic coding sequence
atgccaagccccctgggcccaccctgcctacctgtaatggatcctgaaactaccttggaagagcctgagacagcccgactccgatttcgaggcttttgctaccaggaggtggccggacccagggaggcgttagcaagactacgggagttatgctgccagtggctccagccggaggcccactctaaggaacagatgctggaaatgctagtgcttgagcaattcctcggaacactaccaccagagattcaagcctgggtccgcggacagcgtccaggcagtccggaggaagcagcagccctggtcgaaggcctgcagcatgaccctggccagctgttgggttggatcactgcccacgtgctgaaacaggaagtgctcccagccgcacagaaaactgaggagccgctgggcagccctcacccctccgggactgttgaaagcccgggtgaagggccacaggacactcggatagaaggaagcgtccagctgtcctgtagtgtgaaggaggagccaaacgtcgacggtcaggaagtcgcgccttcctccccacccctcgccgcacaatctcctgagggcaaccacggtcatcaagagccggctagtacaagctttcacccccctcggatccaggaggagtggggccttctcgatcggtcgcagaaagagctgtattgggacgcgatgttggaaaagtatgggaccgtggtaagcctgggcctccctccacaccagcccgaggctcaagcccagtccgagctggggatgctactaactggcacaggagtatgtcggtcccttagaagcggaaacgaatcggaagggccacctgggtgccccgaagcgcagcccccacagggacccggacctgctgcgtgggaagggttaagtggggcagccacgccagctccaacagttagacccggtactcctcctgtccccactcaaccaacaccggctgaaacgcgcctagaaccagctgccactcctcgtaaaccttatacttgtgagcagtgtggccgtggttttgactggaagagcgtgtttgtaatccaccatagaacccatacgtctgggcctggcgtccagtcccccggactcgccacaggggagtctaccgagaagccaccacagggcgaggtcgccttccctcaccatccccgacgttccctgactggtccacggtcctacccttgcgaagagtgtgggtgctcattcagctggaaatctcaactcgtgatccatcgaaaatcacatactggccagaggcgacatttctgcagtgactgtggtcgtgcatttgattggaagagccagcttgtgatccatcgaaaaggacatagacctgaggttccatag

SEQ ID NO: 25325 - DNA, 1044 bp, Artificial Sequence
  Description of Artificial Sequence: Synthetic coding sequence
atgagcatggacaggaagtggcaccccccagcactgcacctgcagcactctcccctgcgaggaactatggacactaagaatcagcccccacatcccagcacacaccctggctttagaagatctggaggctgctggaccggtcaccggaggaattgtacaggaatgagatgttggagatctaccgcccagtggagtccgtgggtgagaacaagtcagcctcacccagcccctctccctggggcttgtacacatccggcagctggtctggctggccagggtctctgtgcaacctcccctacgcagctgagtcatctgcccgaggagcacccagttacctaccaaaaccggcctcatccctctttcatgcaaacaccttgcctcaccgtgccccctacacgcgcagggttgccgccacatcaacccgaggcacaggcacagagtgagttaggcatgctgctcaccggaaccggggtgtgtcgaagcctaaggtcagggaatgaatccgaaggtcccccaggctgcccggaggcgcagccacctcagggcccaggtcccgctgcctgggagggcctgtcaggagcagcaactcctgcccctactgtgcgcccaggaacacctcccgtgcctacacagcctactccagcagaaaccagattggaacctgctgccactcccaggaaaccatacacttgtgagcagtgcggtagggggtttgactggaaaagtgtgttcgtgatccaccaccgaacccacacctctggacctggcgtccagagtccaggactggcgaccggcgagtctacggaaaagcctccacagggcgaggtggcctttcctcaccaccccagaaggagtctcacaggccctaggtcttacccttgtgaggagtgtggctgcagcttctcctggaaaagtcagctggtgattcaccgcaagtcccatacaggacaacggcgacatttctgctccgattgcggacgggcttttgattggaaaagccagttggtgatccacagaaagggccatcggccagaggtcccttag

SEQ ID NO: 25326 - DNA, 468 bp, Artificial Sequence
  Description of Artificial Sequence: Synthetic coding sequence
atgccctctccgcttgggccaccctgcctgccggttatggacccagagactaccctcgaagaacccgagacagcacgattgcgttttcgcggtttttgttaccaggaggttgcagggccaagagaagctctggccagactgcgagagctgtgttgtcagtggctgcagccagaggctcattctaaagagcaaatgttagagatgctggtactggagcagtttttggggactctcccaccagagattcaagcctgggtccggggacagcggccaggctcacctgaagaagccgctgccctcgtcgagggactgcagcatgatccaggacaactcctgggatggattaccgcccacgtcctaaagcaggaagtactgccggcagcacaaaagactgaggaaccgcttggggctcctacgccacaggggcagtggagcccgctgggcaaggtgcccaggacgcccgaatag

SEQ ID NO: 25327 - DNA, 1269 bp, Artificial Sequence
  Description of Artificial Sequence: Synthetic coding sequence
atgcctagccctcttggcccaccatgtctgccagtgatggacccagagactaccctggaagagccggagactgcccgattgagattcaggggcttttgctatcaagaagtggctggacccagagaggcccttgccaggcttcgagaactgtgctgccagtggctccagcctgaagctcacagtaaagagcagatgctggaaatgctcgttttggaacaattcctgggcactttgccaccagagatccaagcctgggtgcgcggacagcgaccagggtcccccgaggaagccgcagcactggtagaaggtttgcagcacgaccctggccagctccttggatggattacagctcatgttttaaagcaggaagtattacccgcagcccaaaagaccgaggaacccctgggatcaccacatcctagcggaacagttgagagccccggtgagggcccacaggatacaaggatcgagggctctgtccagctgtcatgcagcgtgaaggaagaacctaatgtggacggccaggaagtggccccatcttccccgcctctggccgctcaatccccagaaggcaatcatggacatcaggagcctgcaagcacctctttccaccctcctaggattcaggaggagtggggcttactggacagatctcagaaggaattgtattgggatgccatgcttgagaagtacgggactgtggtctccctgggtctgcccccacatcagcccgaggcccaggctcagtccgagctcggaatgttgttaactgggacaggagtatgcaggtctttaaggtccgggaacgaaagcgaaggacctcccggatgtccagaggcccagccgccacagggtccagggccagccgcatgggaggggctgtccggagctgctacacccgctcctacagtgaggccgggaacaccccctgtgcccacacagcctactccagccgaaacaaggttagagcctgccgcaaccccaaggaagccctacacctgcgagcagtgcggacgagggttcgactggaaaagcgtgtttgtcatccaccaccgaacccacacaagtggtccaggggtgcagtcccccggtctggccacaggggagagcacagaaaagcccccacagggtgaggtggccttcccacatcaccctcggaggagcttaactggtccacggtcatacccgtgtgaggaatgtggctgcagcttttcgtggaagtcccaacttgtgattcatagaaaatctcacagacctgaggttccatag

SEQ ID NO: 25328 - DNA, 1353 bp, Artificial Sequence
  Description of Artificial Sequence: Synthetic coding sequence
atgccgagtcccctcggaccaccctgcctgcccgttatggaccccgaaaccaccttggaagaacctgagaccgctcgcctacggttcagagggttctgttatcaggaggtggcagggccaagggaggcgttagcccgactgagagagttgtgctgtcagtggttgcagcccgaagctcacagtaaagaacagatgctcgagatgttagtactcgagcagtttctgggcacactgccccctgagatccaggcatgggtccgaggacaacggccaggctcccccgaggaggccgcagcactggtagaagggctgcagcacgacccaggccagctgcttggttggatcaccgctcatgtgctcaagcaggaggttctccccgctgcgcagaagacagaggagccactgggatccccgcaccctagcggaaccgttgaaagtccaggggaggggccacaggatactaggatagaaggctcagtacagctgagttgttcggtaaaagaggagcctaatgtggacggccaagaagttgccccatccagccctccactggctgctcagagccccgaaggcaatcacgggcaccaggagccggctagcaccagtttccaccctccgagaatccaggaggagtggggccttcttgatcgaagccagaaggaactttactgggacgccatgctggaaaagtacggcacggtggtgagtctgggcctgccccctcaccaacccgaagctcaggcccagagcgaactgggaatgttactcacaggaacaggagtgtgtagatctctgcgctcagggaatgagtctgagggcccacccggatgtcccgaagcgcaacccccacagggacctggccctgccgcatgggagggcctatctggtgcggctaccccagccccaacagtgcgacctggcacgccgcctgttcccacccagccaacccctgcggaaaccaggctggagcccgctgctactcctcgcaagccttacacttgcgagcaatgcgggaggggtttcgattggaaatcggtattcgtcatccatcatcgaactcacacgtccggtccaggagtccagagtcccggtctcgccacaggagaaagcactgagaaaccaccgcagggcgaggttgctttcccacaccatccaaggcgatcattgactgggcctcgatcctatccgtgtgaggaatgtggatgctcattcagctggaagagtcaactggtcatacatcgtaagtcccacaccggccaaagaaggcacttctgttccgattgcgggagggcgttcgattggaagagccagctcgtcattcatcggaagggccacagaccagaggtgccttag

SEQ ID NO: 25329 - DNA, 3042 bp, Artificial Sequence
  Description of Artificial Sequence: Synthetic coding sequence
atgggcgatccaggcagcgaaataatcgaatccgtacctccagcagggccagaggctagcgagtcaaccaccgacgagaatgaggatgatatacagttcgtgagcgaagggcctctgaggcccgtgcttgagtatattgacctcgtgtctagtgacgacgaagagccttctacaagctacacagatgagaacattaaacgaaaagaccacatcgattatcagaaggacaaagtggcgcttaccctcgcccgtttggcaaggcacgtggaagttgaaaaacaacagaaggaggagaagaaccgagcctttagggaaaagatcgattttcagcatgcacatggacttcaagagctggagttcataagagggcacagcgatactgaggcagctcggttgtgcgtcgaccaatggctgaagatgcccggtttaaagacaggtactattaactgtgggactaaatcgagtttcagaaggggcggtcacacatgggtatctggtaagccaatcctatgccccattatgcattgcaacaaggaattcgacaacggacatctgctgctaggccatctcaaacgattcgatcactccccctgtgaccctaccatcacgctccacggcccatttttttcctcctttgcctgtgtggtgtgttacaaaaaatttgtgactcagcagcagtatcgggatcacctgttcgacaaagaagccaccgatgacggtcataataataatctgctgccacagattatccagtgctttgcctgtccaaactgtttccttttattcagccgtaaggaagagtgctctaaacatatgtctggaaagaaccatttccatcagagcttcaaattgggcgataacaaaggaatcgctcacccgatttcattcccttcctttgcaaagaaactgctcatttctctctgtaaagacgtgccatttcaggtgaaatgcgttgcctgccataaaacgctgaggagccatatggagctaacagcccatttccgtgtgcactgccggaatgctggtcctgtcgctgtcgccgaaaagtctatcactcaggtggctgagaaattcatcctgagaggttattgtccggactgcaaccaggttttcgtggacgagacttctacacagaatcataaacagaattcggggcacaaggtgcgcgtgattaacagcgtcgaggagtctgttttactgtactgtcacagcagcgaggggaacaaggacccaagtagcgatctacacctcttattggatcaaagcaagttttcttctctgaagagaactatgagtatcaaagaatcgagctctctagagtgcatcgccatccccaagaagaaaatgaacctcaaggacaagtcacacgaaggtgtggcctgtgtccaaaaagaaaaatccgttgtgaagacctggttttgcgagtgcaatcagaggttccctagcgaggacgctgtggaaaagcacgtattcagcgccaacacaatggggtataagtgtgtggtatgtggtaaagtctgtgatgacagtggagtaattcgcctccatatgtctcggatccacggaggagcccacttaaataactttctgttttggtgtcgcacatgcaaaaaggaacttaccaggaaagacacaatcatggcgcacgtgacggaatttcacaatggtcaccggtatttttacgagatggacgaggtcgagggtgagacgttgccaagcagttctacaaccctcgataacctgacagcaaataagccctctagtgctatcacagtcattgaccatagtccggctaactcatctcctagaggtaaatggcagtgtagaatctgcgaggatatgttcgactcacaggaatacgtgaaacaacactgcatgtcactggcctcccacaagtttcacagatatagctgcgcccattgcaggaaaccgtttcacaaaatcgaaaccctatatagacactgtcaagatgaacacgacaatgaaataaagatcaagtacttctgtggcctgtgtgatctcattttcaacgtggaagaggccttcttaagtcactacgaggaacaccacagcatcgattatgtgttcgtgtctgaaaagaccgagacttccatcaaaacagaagacgactttcctgtcatcgagaccagtaatcagctgacctgcggctgtcgcgagagctacatctgcaaagtgaaccgcaaggaagattatagccgatgcctacagatcatgttagataaggggaagttatggtttcgctgcagcctttgtagcgccacagcacagaacctcaccgatatgaacacccatatccaccaggtacacaaagagaaatccgacgaagaggagcagcagtacgtgatcaaatgtggaacttgtaccaaggccttccacgatcctgagagcgctcagcagcatttccaccgtaagcactgcttccttcagaaaccctctgtcgcccactttggcagtgagaagtccaatttgtataagtttacagcctccgctagccacaccgaaaggaagctcaaacaagctataaattattccaagtctctggacatggagaagggggtagagaatgatttgtcttaccagaatatcggtggcaatacaaattggaagccaccgctgaactgtaaaatctataattacctgaatagaatcggctgtttcttcttgcacccccgttgttctaagagaaaagacgcagcagacttcgccatctgcatgcatgccggaagattagatgaacagctgccgaaacagatacccttcaccatcctgtcaggagaccagggctttttagaactagaaaatcaatttaagaagacccagcggcctgctcatatcctgaacccacaccacctggagggcgacatgatgtgtgccctgctgaacagcattagcgatacaacaaaggagtgtgatagtgatgataacatgggcgcaaagaatacctcaatcggggaagaattcatttctactgaggatgtagagttagaggaagctattcggagaagtctcgaggagatgtag

SEQ ID NO: 25330 - DNA, 3186 bp, Artificial Sequence
  Description of Artificial Sequence: Synthetic coding sequence
atgggagatccgggatcagaaatcattgaaagcgtaccccctgctggcccagaagcatccgagtctactacggatgagaatgaggatgacattcaatttgtttctgagggtcccctgaggccggttctggagtacattgatctcgtgtccagcgacgatgaggagcctagtacctcatatactgacgaaaacataaagaggaaggaccacatcgactaccagaaagacaaggtggccctgacactggctaggctcgcaagacatgtggaagtcgagaagcagcagaaggaagaaaagaacagggcctttcgcgagaagattgattttcagcacgcgcatggccttcaggagcttgaattcattagaggccacagcgacacagaggcggcaagactgtgcgttgaccagtggttaaagatgccaggattgaagacaggcacgattaactgtggaacgaaaagttcctttagacgcggaggccacacctgggtctctggtaaacccatactgtgccccataatgcattgcaataaagagtttgataacggtcacctcctgctcggccacttaaagcggtttgatcactccccctgtgaccctactattacacttcacggcccttttttcagcagcttcgcctgtgtcgtgtgctacaagaagtttgtgacccagcagcagtatcgggatcacctttttgacaaggaagccacagatgacggccacaacaataacctactgccccagataattcagtgctttgcatgtccaaactgctttctactcttctcacgcaaggaggagtgcagtaagcatatgtccgggaagaaccatttccaccagtcattcaagcttggtgataataaaggtattgctcaccccataagcttccccagcttcgctaagaagctcctgatcagcctctgtaaggacgttccatttcaggtgaagtgcgtcgcatgccataaaaccctacgcagtcacatggaactgacagcacactttcgagtgcattgcaggaatgcgggaccagtggcagttgcagagaaatccattacccaggtggccgaaaagttcattctccggggttactgcccagactgtaaccaggtcttcgtcgacgaaacctctactcagaaccataaacagaattccggccataaggtgagggtgatcaatagcgtcgaggaaagcgtcttgctttactgccactcctccgagggtaacaaggatccctctagcgatctgcatttgctactggatcagagcaagttcagctcattgaaaaggacaatgagcatcaaagaaagcagctccctggaatgtatcgcgattccaaaaaaaaaaatgaacttgaaagacaaatcccacgaaggcgtcgcttgtgtgcagaaggaaaagtccgtggtcaaaacatggttctgtgagtgtaatcaaagattccctagtgaggacgcagttgagaagcacgtgttcagtgctaacacaatgggatataagtgtgtagtgtgtgggaaagtgtgtgatgactccggtgtcatccgcctgcacatgtcacgcatccacgggggagctcatctgaataatttcctcttttggtgtagaacatgtaagaaagagcttacacggaaagacacaattatggcccatgtgaccgaattccataacgggcatcggtacttctacgaaatggatgaggtggagggggaaacactgccatcatcaagtacaacactggataacctcacagctaataagcccagtagtgccatcaccgtgatcgaccatagtccggcaaattcaagccctagagggaaatggcagtgcagaatctgcgaagacatgttcgactcccaggagtacgttaaacagcactgcatgtcattagccagccataagtttcatagatactcctgcgcccattgcaggaagccgttccacaagatagagactctgtatcgccactgccaagacgaacatgataacgagataaaaatcaaatacttctgcgggctctgtgatttaatcttcaacgtggaggaagcttttctcagccactatgaggagcaccattcgatcgactacgtgtttgtctctgaaaaaactgagacctccatcaaaacggaagatgacttcccagtcatcgagacttccaaccaactgacatgcggttgtagagaaagctatatctgtaaggttaataggaaagaagattatagtcggtgtcttcagatcatgttggacaaaggcaagctctggtttcgatgctcactctgctctgctaccgcccaaaacttgacggacatgaatacccatatccatcaagtgcacaaagagaaatctgatgaggaagaacagcagtacgtgataaaatgcggcacgtgcaccaaggcctttcacgaccccgagtccgcccagcagcactttcacagaaagcactgtttcctgcaaaagccttccgtggcccatttcggatctgaaaagtccaatctttacaaattcacagccagtgcaagccataccgagcggaaactcaaacaggccattaattacagcaagtctctggacatggagaagggcgtggagaatgacttaagctatcaaaacatagaagaggagattgtggaacttcctgacctcgactatctgcgtactatgactcacattgtctttgtggacttcgataattggagcaacttcttcggacacctacccggacacctaaaccaggggacctttatctgggggtttcaaggcggtaatacaaattggaaacctcctcttaactgcaaaatttacaattatctgaaccgtatcggctgttttttcctccacccacgctgcagtaaacgaaaggacgctgccgacttcgccatctgcatgcacgctgggagactcgatgaacagctgcctaaacaaatccccttcaccatcttaagtggagaccaaggttttctggagctcgagaaccaattcaagaagacacagagacctgcacatatactgaatccacatcacctggagggtgacatgatgtgcgctctgctgaatagtatcagcgacaccacaaaggagtgcgattcagatgacaacatgggagcgaagaacacgtccattggagaggaattcatctccacggaggacgttgagctggaggaggccataagaaggagcttagaggaaatgtag

SEQ ID NO: 25331 - DNA, 1680 bp, Artificial Sequence
  Description of Artificial Sequence: Synthetic coding sequence
atgggggacccgggaagtgagattatcgaatccgtacccccagccggacccgaagcaagtgagtctaccacagacgagaatgaggacgatattcagttcgtgagtgagggaccgctccgccctgtgctggagtatatcgatttagtgtcctcagacgacgaagagccttcaacatcctacacagaccggatgccggagagcaaggttccctcttctgaaaatcaccggccagaaatgtgctcttcatgcaatgttcccctgcctatcggcgactccagcagcttttccggcagttgcagctcatcgccggaaaggatcgtatcccaaacaagctcggtggagaaccccttggagaatcagaaaaatgatcagaataattcagacacaaagatcagcgaaactgagactctcaagagctcccagaactttcagacgctgccaagctctccattattggtgcctcaagagtctttggcgagctccgaggtgaaggaaaacctgagaattgactcgagctccgcctctcagcacggtagggacgccatattgtacctgcaaactcaggttgctgagatgtcgagggtgattcgggaccttcagagtaggtcatgtttccgctttcatcattcaaggccctccgagaactcaagcgtgccatgggatattagtacatctaaggaagagaatttatcaaccgtcgaagaagaaaccgattacaaatccccctccgccgatgacaagggtcagccctcggatccaagccagagcagctttaccggcctgctgaagcgaatggagcagcgcggagttatcaaacgggttacgctacaaagtgaggcagagtcctgcgaggggaagcctgattgcgtcacttcgaagaaacgattggtcccacccctccaccctttgctacgcattgcaacaaccgaggtattcaaagaccccgctgactgtcacccttccagcttcatggggcaccgtgtgtaccctgtggctaaggacacctccccatttcagccaaacccgcctgcagaaggaccgattgtcgaggctcttgaacatagtaaaagaggcaacacaacttccccactggatagcaccagcaaggaaatggaagtgatgggatgcagattttaccatgctgctagcatcgctgccagagctgcttcttacatggcctacatgacacaatatcagcgcaagctgtgggaggatatggaggacctggtgcacgatccagagtttgatcggggtaaggccaggtgcatcatttccgatggcatggacgccggtctgtggcagttgtgcacgacgagggatatcatggactctgtggtgcgagtgatggcaatggctatcgactaccgtagacaggcttggcttagactgacctctcttacaaagaagacccaggaaaaaattagtcacctaccctttgacggcacttccctcttcggccaggacgtgaaggccgtagtggccgaggataacaacatcaaagaaaatgactacaaagaccataagtactacaaccagcaccgatatttctactcccacgaccaaaaagcccattatcacaacaggggttactccaaaggcgactggtataaaccacggaaccatccgtatagatacagaaagaaaggggactccccagagagacacggatacaagaattag

SEQ ID NO: 25332 - DNA, 1569 bp, Artificial Sequence
  Description of Artificial Sequence: Synthetic coding sequence
atggccgttagtcacctgccaacaatggtgcaggaatccgtgaccttcaaggatgtagcaatactcttcacccaggaggagtggggccaattatctccagcccagagagcgctttatcgcgatgtcatgctggaaaactatagcaatctggtctccctgggactactggggccaaagccggatactttctcccagctcgaaaaaagagaggtctggatgcctgaggatacccctgggggtttctgcctagactggatgactatgccggctagcaaaaagagtacagtgaaagcagagattcccgaggaggaattagatcagtggacgattaaggaaaggttttcctcctcatctcattggaagtgcgccagcctcctggagtggcagtgcggcggtcaagagatctcactgcagagggtcgtgctcactcaccctaacaccccctcccaggaatgcgatgaatctggatctacaatgtccagtagtctccattcagaccagtcccagggctttcagccatccaagaacgccttcgagtgctcagaatgcggtaaggtgttttccaaaagctctacactgaacaagcaccagaagatccacaatgaaaagaacgctaaccagaagattcatattaaggaaaagagatatgagtgcagagagtgcgggaaagcctttcaccagtccacacatctgatccatcatcagcggattcacaccggcgagaaaccttacgagtgtaaagaatgtggcaaggccttttcagtcagcagctctctcacataccaccagaaaattcacacgggcgagaagccatttgagtgcaacctttgcggaaaggcattcatacgaaatatccatctggcccatcatcatagaattcatactggcgagaaaccattcaaatgcaacatttgcgagaaagctttcgtctgcagggctcatttgactaagcatcaaaacatacacagcggcgagaagccttacaagtgcaatgagtgtgggaaggcctttaaccagtctacctcctttttgcagcatcagcgcatccatactggggaaaaacccttcgagtgtaacgaatgtgggaaggcctttagagtaaatagtagcctgacagaacaccagcgcatccacacaggggagaagccttacaaatgtaacgaatgtggaaaggcctttcgagacaactccagcttcgctcgacacagaaaaattcatactggagagaaaccgtatcggtgtggactgtgcgaaaaggcatttcgagaccagtctgcactggctcagcatcagagaatccacaccggagagaagccttacacatgcaatatttgtgagaaagctttcagtgatcacagcgccttgacccagcataagcggatccacacacgtgagaaaccttacaaatgcaagatctgcgaaaaggcattcatccggagtacacatctgactcagcaccagcggattcacaccggtgagaaaccttacaagtgcaacaagtgtggaaaagccttcaaccagacggccaaccttatccagcatcagcgacaccatataggagaaaagtag

SEQ ID NO: 25333 - DNA, 1569 bp, Artificial Sequence
  Description of Artificial Sequence: Synthetic coding sequence
atggcagtgtcccatctccccaccatggtgcaagagagcgtaacttttaaggacgtcgccattcttttcacccaggaagaatggggacaactttctccagcacagcgtgcgctgtaccgagacgtgatgctggaaaactattcaaacctagtgtcgctgggcctgctgggacctaagcctgacacattctcccaactcgagaagagggaggtgtggatgccagaagataccccaggaggcttttgccttgactggatgactatgcccgctagcaagaaaagtaccgtcaaagcagagattcccgaggaggaactcgatcagtggactatcaaggagcgcttctcctcatccagtcattggaaatgtgcaagtctcttagagtggcagtgcggcggtcaggagatcagcctccagcgcgtggtgttgacccatcccaacaccccgtcacaggaatgtgacgaatcgggaagcaccatgtcttccagcctccattctgatcagagccaaggtttccagccatcaaagaatgctttcgaatgtagcgaatgtgggaaggtgttctctaagtccagcactctgaacaagcaccaaaagatccataacgaaaagaacgccaatcagaaaattcatattaaggaaaaacgctatgagtgcagggagtgcggtaaggctttccaccagagtacgcacctcatccatcatcaacgcattcacacaggcgaaaaaccctatgagtgcaaggagtgcggtaaagccttctccgtgagctcgtctcttacatatcaccagaagatccacaccggagaaaagccttttgaatgcaacctgtgtggtaaggcctttattaggaacatccacctcgcacaccaccacagaattcatacgggcgaaaagccatttaagtgtaatatttgtgagaaagcctttgtatgccgggcacacctgactaaacatcaaaatattcattctggggagaagccttataagtgcaatgagtgtgggaaagcctttaatcaaagcacaagcttcctgcagcaccagcggattcacacaggggagaagccatttgagtgtaatgaatgcggcaaagcctttagagttaactcctctctgaccgagcaccaaagaatccatacaggcgaaaaaccatataagtgcaacgaatgtgggaaagcttttagagacaacagtagcttcgccagacacaggaaaattcacacaggggagaagccatacaggtgcggcctgtgcgaaaaagcctttcgggatcagtctgctcttgcacaacaccaaagaattcacacaggtgagaaaccttatacctgtaacatctgtgagaaggctttctctgaccactctgcactgactcagcataagaggatccatacaagggagaagccctataagtgcaaaatctgcgaaaaggccttcatacgcagcacgcacctgacccagcaccaaaggatccacactggtgaaaaaccgtataagtgtaacaagtgcgggaaagcgttcaatcaaaccgctaacttgattcagcaccagcggcaccacatcggcgagaaatag

SEQ ID NO: 25334 - DNA, 7521 bp, Artificial Sequence
  Description of Artificial Sequence: Synthetic coding sequence
atggaagttctgcaatgcgacggctgtgacttccgtgctcccagctatgaagacctcaaggctcacatccaagatgtccataccgcatttttgcagccaacagacgtggcagaggacaacgtaaacgagctccggtgtggatccgtgaacgctagcaaccagaccgaggtggaattctcttccatcaaagatgagtttgcaatcgccgaagacttatctggacagaacgccacatctcttggtaccggcggatactacggccactcccccggatattatgggcaacatattgctgccaatcccaaacccactaataagttctttcagtgcaaattctgcgttcggtactttagaagtaaaaatcttttgattgagcatacccggaaggtgcacggagcccaggcagagggctccagcagcggacctcccgtacccggatctctgaactataatattatgatgcatgaaggctttgggaaagtcttcagctgccaattctgtacttacaaaagtcctagacgggctagaatcatcaagcaccaaaagatgtatcataagaacaatcttaaagaaaccaccgctccccctcctgctcctgccccaatgcctgacccggtggtgccaccagtgagtctgcaggacccttgtaaggaactgccagcagaggtcgtagagcggagtattctggaatcaatggtaaagcccctaacaaaatctcggggtaacttctgctgtgaatggtgctcctatcagaccccgcgtcgcgagaggtggtgcgatcacatgatgaagaagcataggtcaatggtcaagattttaagcagcctcagacagcagcaggaggggaccaacttgccagacgtgccaaacaagtccgccccttccccaacatctaatagcacatacctgactatgaatgcggcaagtcgggagattcccaacacgactgtgtccaactttcgtggtagcatgggcaatagtattatgagacccaacagctccgcttccaagttcagccccatgtcttacccccaaatgaagcccaagagcccacataacagtggcctggtgaacctcaccgagcgcagcaggtacggcatgacagacatgaccaactccagcgctgatctggagactaacagtatgctcaacgattcctcctcagatgaagagctgaatgaaattgatagtgagaatggccttagtgccatggatcaccagacttccgggctaagtgctgaacagctgatggggtccgatgggaataagctgctcgagaccaaaggcatcccatttcgtcgcttcatgaaccgatttcagtgccccttttgtccttttctcacaatgcaccggcgtagtattagtcggcacatcgaaaacatccatttgagtggcaaaacagctgtgtacaagtgtgatgaatgcccgtttacctgcaagagctccctcaaattgggcgcacacaagcagtgtcatactggaaccacttccgattgggatgccgtgaactcgcagtcagaatcaataagcagctcactgaacgagggggtcgttagttacgaatcgtctagcattaatggtcggaagagtggcgtgatgctggacccccttcaacagcaacagccgcctcagccaccgcctccccctccaccaccgcctcctagccagccccagcccctccagcagccccagccgcctcagctccaaccaccccatcaggtcccgcctcagcctcaaacccaacctcctcccacgcagcagccacagcccccaacgcaagccgctcctttacatccctacaaatgtaccatgtgcaactactctacaaccactctaaagggactgagggtccaccaacagcataaacactccttttgtgacaatttacccaaatttgaaggccaacccagtagcctcccactcgaaaatgaaacagattcccatccaagcagcagcaacactgtcaagaagtctcagacctctattctgggccttagttccaagaacaatttcgtggctaaggcctcgaggaaattggccaatgatttccccctcgatttgtcgcctgtcaagaaaagaacccggattgacgaaatcgccagcaacctccagagcaaaattaaccaaacaaagcagcaggaggacgccgttatcaacgtagaggatgacgaggaggaggaggaggacaacgaagttgaaatcgaggtagagttagaccgggaggaagagcccactgagccaatcatcgaggtgcccacaagcttttccgcacagcaaatctgggtccgcgatacaagcgaaccccagaaagaaccgaacttcaggaacattacccacgattataacgccactaatggggcagagattgaactgactcttagtgaagacgaggaggattattatggaagctccactaacctcaaggatcatcaggtgagcaacacggcacttttaaacacccagacaccgatctatggcacagaacacaattcggagaatactgacttcggggattccggcagactttattattgtaaacactgcgatttcaacaacaaatccgctaggtctgtgtccacccactaccagcgcatgcatccctatataaaattctctttccggtacatactggaccctaatgaccatagcgccgtttacaggtgcctagagtgctatatcgactacactaatttcgaagatctgcagcagcattacggtgagcatcatcccgaggctatgaatgtcctcaattttgatcacagcgatctgatttatagatgcagattctgttcttatacaagtcctaatgtccggtctctcatgccgcactatcagaggatgcatccaactgtgaaaatcaataatgccatgattttcagttcgtatgtggtggagcaacaggagggtctgaacacggagagtcagaccctacgagaaatacttaattctgcacctaaaaacatggcgaccagtacgcctgtggccagaggcggtggtctgccggctactttcaataagaacacccctaagaccttcactccggagtgcgagaatcagaaagacccgctcgttaacaccgtcgtggtttacgactgtgatgtctgctcattcgcttctccgaacatgcattccgtcctggtccactaccagaagaaacatccagaggaaaaggcttcatatttccgcattcagaagaccatgaggatggttagcgtcgatagaggtagcgcactctcacagctctcattcgaagtgggagcaccaatgtctccaaagatgtcaaatatgggtagcccgcctccccctcagcccccacctccagatctctccaccgagctgtactattgtaaacattgtagctattccaataggtctgtcgttggagtgctcgtacactaccagaagcgccaccccgaaattaaggtgactgccaagtatatcagacaagccccacctaccgcagccatgatgcgcggagtggagggaccccaggggtccccaagaccaccagccccaattcaacagctgaatagaagttctagcgagagagatggccctcccgttgaaaacgagatgttcttctgccagcactgtgattatggcaatagaacggtgaagggagtgttgattcactaccagaagaaacaccgagatttcaaggctaacgccgacgtcattaggcagcacactgcgaccattaggagcctgtgcgaccggaaccagaaaaaacccgcatcctgtgttttggtatctccctctaatcttgagcgtgacaagacgaaattacgcgctctcaagtgccggcaatgctcttacactagcccttatttctatgcactcaggaagcacataaagaaagaccatccagccctcaaggctaccgtcacctcaatcatgcgctgggccttccttgatggcttgatcgaggcaggctaccactgtgagtggtgcatctattcacatactgagcccaatggtcttcttctccactaccagagaaggcatcccgagcactacgttgactatacttacatggcaaccaagctgtgggcaggaccggacccctcccctccctcattgactatgccggcagaagccaagacatataggtgtagagactgtgtgtttgaagccgtgtccatctgggacatcactaaccattatcaggcatttcacccgtgggcaatgaatggtgacgaatccgtgctgcttgatatcatcaaggagaaggatgccgtagagaagcccatcctgagcagcgaagaactcgccggaccagtcaattgtgaaaattccatcccgacgcctttcccagagcaagaggcggagtgtcctgaggatgcccgacttagccccgaaaagagtctgcaacttgcttcggccaaccctgccattagttcaactccataccaatgcacagtctgtcagagcgagtataataatctgcacggattgctgacccactacgggaagaaacatccgggaatgaaagtgaaggcagctgattttgcccaagacatagatattaatcccggtgccgtctacaaatgcagacattgcccttacatcaacacacgcatccacggcgtgctgactcactaccagaagaggcatcctagtataaaggtaaccgccgaagatttcgtgcacgatgttgaacagtccgccgacatatctcagaacgatgtcgaggagacctctaggattttcaagcagggatacggggcatatcgatgtaagttgtgcccctatacccacggaaccctggaaaaattaaagatccactacgaaaagtaccacaaccagcctgaattcgacgtgttctctcagagccccccaaagctgcctgtgccgctcgagcctgagatgaccactgaggtgagcccttcacaggtttcgattaccgaagaggaggtcggggaagaacccgtctcaacttctcactttagcacgagtcatctcgttagccataccgtgtttagatgccagctgtgtaagtacttttgctctacccgtaaaggcatcgccagacattaccgcatcaaacataataatgtgcgagctcagccagagggcaagaataacctgttcaagtgcgctctatgcgcctacacgaacccaataaggaagggtctggctgcccattatcaaaaaaggcatgacatcgacgcctactacacacattgtctcgccgcttccaggacaataagcgacaaacccaataaggtgataataccaagtccgccaaaggacgacagccctcagttgtccgaggaactgagacgtgccgtggagaagaagaaatgtagtctgtgctcctttcagtcttttagcaaaaagggaatcgtctctcattacatgaaacgacacccaggagtctttcctaagaaacagcatgcgtccaagttgggaggttatttcacagccgtctacgctgacgagcacgaaaaacctacactaatggaagaagaggagcgaggcaacttcgagaaagcggaggtagaaggggaggcgcaagagattgaatggctgccattccggtgtatcaaatgttttaagctgtcctttagcactgcggaacttttgtgcatgcactatacggatcatcactctagagacctcaaacgagattttataatcttagggaacggccctcgcctgcagaacagtacttaccagtgtaagcactgtgatagtaaactgcagtccacagccgaacttacaagccacctaaacatccacaatgaagagttccaaaaacgggctaagagacaggaacgccgtaaacagctcctgtccaagcaaaagtatgccgacggagcctttgctgactttaagcaagagaggcctttcgggcatctggaggaggttcccaagatcaaagagagaaaggtggttggatataagtgtaaattttgtgtcgaggtgcatccgacgttgagggccatttgcaaccacctgcgaaagcatgtgcagtatgggaatgtaccagctgttagcgctgcggtcaagggactccgcagtcatgagcgatctcacctggcactggcgatgttcacgcgcgaagacaaatatagctgccagtactgttcttttgtttcggctttcagacataatcttgacagacatatgcagacccatcacggccatcataaacctttccgttgcaagctgtgttcattcaagagcagttacaacagtcgcctgaaaacccatatcctcaaagcgcatgctggggaacatgcttacaagtgctcttggtgctcgttttcgaccatgacaatctcccagctcaaggagcactctttgaaggtgcacggaaaagcacttaccctccctagacccaggatcgtgtcattgctgagctcccatagccaccacagtagccagaaagccaccccagcagaggaggtggaagattcaaatgactcaagctattctgagcctcccgacgtccagcagcaactgaaccattaccaaagtgccgcactggccagaaataactcccgtgtgagtcctgtgccactgagcggcgcagctgctgggaccgaacagaagaccgaggctgttctgcactgtgaattctgcgaattcagcagcggttatattcaaagcatccgcagacactacagggacaaacacggaggaaaaaagttattcaagtgtaaggattgctcattctacaccggtttcaaaagtgcgttcaccatgcatgtcgaggccggtcattctgcagtgcctgaggaaggaccaaaggatcttagatgcccattgtgcttgtaccacaccaagtataaaagaaacatgattgaccacatcgtcctccacagagaagagagagtcgtacctattgaggtatgccggtcaaaactctcaaagtatttgcagggagtagtcttccgatgtgacaagtgtacatttacctgctccagcgacgagagcctgcagcaacacatagaaaaacacaatgagttaaaaccctataaatgccagctttgctattacgaaactaagcataccgaggagctggattcgcacctgcgcgacgagcacaaggtatccaggaattttgagctggtagggcgtgttaatctggatcagctggagcagatgaaggaaaaaatggaatctagtagttccgacgacgaggacaaggaggaggagatgaatagtaaggccgaagaccgggagcttatgcgcttctccgaccatggagccgcactcaatactgaaaagaggttcccttgtgagttctgcgggagagctttctcccaggggtctgagtgggagaggcacgttcttagacacggaatggctctcaatgacacaaaacaagtgtctcgggaagagatccatccgaaggagattatggaaaacagcgttaagatgccttcgatcgaggaaaaagaggacgatgaagccatcggaattgatttctcacttaaaaatgagaccgtggccatctgcgttgtcaccgcagataagtccctgctggaaaatgctgaggcaaagaaggagtaa

SEQ ID NO: 25335 - DNA, 627 bp, Artificial Sequence
  Description of Artificial Sequence: Synthetic coding sequence
taagagcattccctcaaggtccatgggaaagcactcacactgcctagacctagaatcgtctcgttgttgagcagccattcacaccactccagccagaaagccacccccgctgaggaagtggaagacagcaacgatagttcatactctgagcctcctgacgtgcagcagcagttgaaccattaccagtctgccgcactggcacgtaacaatagtagagtcagccctgttccgctgtcaggggctgccgctggcaccgagcagaagaccgaagctgtgctgcattgcgaattttgtgagtttagctccggctacatacagagtatccgcaggcactatcgcgacaaacacggaggcaagaagctgtttaagtgtaaagattgttcattctatactgggtttaagtccgctttcactatgcacgtggaagctggtcactctgcagtgccagaggagggtccgaaggacctgcgttgccctctgtgtctgtaccatacaaagtacaagagaaacatgattgaccacattgtcctacaccgaggcaatttgagcaacctggtctttctagacgctgcaggcggaagacagcagagatggccaagccgtgacgcactttcagagtggcagtag

SEQ ID NO: 25336 - DNA, 7700 bp, Artificial Sequence
  Description of Artificial Sequence: Synthetic coding sequence
atggaagtactgcaatgcgatggatgtgatttcagggccccttcatacgaggatctcaaagcacatattcaggatgtgcacaccgctttcttgcagcctacagacgttgcggaggataatgtcaatgagctccgttgcggctctgttaacgctagcaatcagaccgaagtcgaattctcttcaatcaaggacgagttcgccatcgcagaggacctgtcaggtcagaacgccacctctttaggtaccggtgggtactatggacactcccccggttactacggacagcacatagctgcaaacccaaagccgactaataagttttttcagtgcaaattttgtgtgaggtatttcagatccaaaaatctcttgatcgagcacacaaggaaggtgcacggtgctcaggcagaaggctcatctagtggaccacctgtccccggttccctgaactataacatcatgatgcatgagggtttcgggaaagtgtttagctgccagttctgcacatataaatctcctcggagggcgagaattattaaacaccagaagatgtaccataaaaacaacttgaaggagacaacggcccctccccctgctcctgcccctatgcctgatcccgtagtccctcccgtcagtctacaagatccgtgtaaagagctgcctgctgaagtcgtcgaacggagcattctggaaagcatggttaagcctcttacaaagagtcgaggcaacttttgctgcgagtggtgttcttaccagacccctaggcgggaaaggtggtgcgatcacatgatgaagaagcatcgatctatggtgaagatcctctcaagccttcgacagcagcaggagggaactaatttgccagacgtgccgaataaatccgctccttcacctaccagtaatagtacatacctgacaatgaacgccgcaagccgcgagatccctaacactaccgtgagcaatttcagaggcagcatgggaaattccataatgaggccaaactcctccgcctccaaattttcccccatgagctaccctcagatgaagcctaagtcaccccataacagtgggttagtgaatctcaccgaacgctcacggtacggcatgaccgacatgactaacagttcggccgacttagaaacaaacagcatgttgaacgacagttcctcagacgaagagctgaatgagattgatagtgagaacggcttgagtgccatggatcatcagacctctggattgagcgcagagcagttgatgggttccgacggaaacaagctgctggaaactaagggtatccctttcaggcgcttcatgaataggttccaatgccctttttgcccttttctgaccatgcaccgcagaagtattagcaggcatatcgagaacattcacttgagcgggaaaactgcagtgtacaaatgcgatgagtgcccattcacatgcaagtcctcgttgaaactgggcgcacataaacagtgccatactgggactacgtctgattgggacgcggttaacagtcagagtgagtctatctctagttccttgaatgaaggagtcgtgagctacgagtcctcgtccattaatggacgcaagagcggggttatgctcgacccactgcaacagcaacaaccccctcagcctcctcccccaccgcctccccctcccccatcccagccccagcccctgcagcagcctcaaccaccacagctgcaaccccctcaccaggtacctccacagccccagacccagccacccccaactcaacagccacaaccccctacccaagctgccccactgcacccttacaagtgcacaatgtgcaactattcaaccacgaccctcaagggattacgagtgcatcagcagcataagcattcattttgcgacaacctgccaaagtttgaggggcaaccatcctcattgcctctggagaatgagacggactctcatccttcatcgagcaataccgtgaaaaagtctcagacaagcattctggggttgagcagtaagaataattttgttgccaaggcatctcggaagttggccaacgacttccctctggatctgtcacctgtgaagaaaaggactcggatagacgagattgcatccaatcttcagagtaagatcaatcaaaccaagcaacaggaagatgccgtcatcaacgttgaggacgacgaagaggaagaggaggataacgaggttgagatcgaagtggagttagacagggaggaagaacccacagaaccgatcattgaggtacccaccagcttctctgctcagcaaatctgggtgagagatactagcgaaccacagaaggagccaaactttagaaatattacacacgattataacgccactaatggagccgagattgagctgactctctctgaagatgaagaggactattatggctcctctaccaacctcaaggaccaccaggtatcaaacaccgctcttctcaacacccagactcctatttacggcaccgaacacaacagtgaaaatactgatttcggcgatagtggacggctttattactgcaaacattgtgatttcaataataaaagcgcacgcagtgtgagtacacactaccagcggatgcatccctacatcaagttcagcttcaggtacattctcgacccaaatgatcattccgctgtgtatcgctgtctcgagtgctacattgactatacaaactttgaggacctccagcagcactacggtgaacatcacccagaggccatgaatgtgctgaattttgaccatagtgacttgatatacaggtgcaggttctgcagttacacatctccaaatgtccgctcgttgatgcctcactatcaaaggatgcatcctacagtaaagatcaataacgcaatgatcttctctagctacgttgttgagcagcaagagggcctgaataccgagtctcagactttacgggaaatactcaactccgcccctaagaatatggcaacttcaacccctgtcgctcgcggtgggggactgcctgcaacgttcaacaaaaatacaccaaaaacgttcacccctgagtgtgaaaatcagaaggatccactcgtcaacactgtggtagtttacgactgtgatgtttgctccttcgcctctccgaatatgcactctgtgctggtgcactatcagaagaaacatcccgaagagaaggcttcctattttagaatccaaaagaccatgaggatggtcagtgtggatcggggaagcgctttatcccagctctcttttgaggtcggtgctcccatgagtccaaagatgagtaacatgggaagccctccacctcctcaacctccccctcctgacctgagcaccgagttatattactgcaagcactgcagttacagtaaccgctcagtggtaggtgtgctcgtccactaccagaagcgccacccagagattaaagtgaccgcaaaatacatcaggcaggctccccctacagcggcaatgatgcgcggagtcgaggggccacagggttctccaaggccccctgctcctattcagcaacttaatagaagcagttctgaaagagacgggcctccagtggaaaatgaaatgtttttctgtcagcactgcgattacggcaatcggacagtgaaaggagtgctcatccactatcagaagaagcaccgcgacttcaaggcgaacgcggacgtgattcggcaacacaccgctactattcgttcattatgtgaccgcaatcaaaagaagcccgcttcatgcgtgctcgtgtccccatctaacttggaacgcgacaagaccaaattgcgggcattgaagtgtcgtcagtgcagctatacctctccctatttctacgctctccggaaacatatcaaaaaagatcaccctgccctgaaagccactgtgactagcattatgcgttgggctttcttagatggattgatcgaagctggttatcactgtgagtggtgcatctactcccatactgagccaaatggcctattgctccactaccagcgaaggcatcctgaacattacgtggattatacgtatatggctacgaaattgtgggcgggacccgacccatcccccccaagcctcaccatgccagccgaagccaagacctaccgatgtagggactgtgtgtttgaagccgtgtcaatttgggatatcaccaaccactaccaagcattccacccatgggccatgaacggagacgagtccgtgcttttggatattatcaaggagaaggacgccgttgagaagcctatcctgtcttcagaagaactcgctggacctgtcaattgcgaaaacagtatccctacacctttcccagagcaggaggccgagtgcccagaagatgcgagactatcccccgaaaagtcgctccagcttgcttccgccaacccggcaatctcctcaactccctaccaatgtactgtgtgccagagcgaatataacaacttacacgggttactcactcattatggcaaaaagcaccccggaatgaaggtgaaggccgcagacttcgcccaagatattgacataaatcctggagcagtgtataagtgcagacattgcccttacattaatacccgcatacatggagtcttaactcactatcaaaagcgtcatccttcaatcaaagtcaccgcggaggatttcgtccacgacgtggagcagtcagcggacattagccagaacgatgtcgaagaaaccagccgcatcttcaagcaagggtacggagcttacagatgtaagttgtgcccatacacccacggtaccttggaaaaacttaagatccattacgagaagtaccataatcaacccgagtttgatgttttttcgcagagccctccgaaattgcccgtgcccctggagcccgagatgacaaccgaggtgagtcccagccaggtgagcataacagaggaggaggtaggcgaggagccagtctcaactagtcacttcagcacgtcccatctggtgtcacacacagtttttcgctgccagctctgcaagtatttctgcagtactcgcaagggaatcgccaggcactacagaattaagcataacaatgtcagagcccagcctgaggggaagaacaacctctttaagtgcgctctgtgcgcttacacaaatccaatacgcaaggggcttgcagctcactatcagaagagacatgacatcgatgcgtattatacccactgccttgccgcatcccggactattagcgataaacccaacaaagttattatccccagccctccgaaggatgacagcccacagctgtctgaggaactgcgtagggctgtagagaaaaaaaaatgctccctatgctctttccaatcatttagtaaaaagggaatcgtgtcacactatatgaagcggcatcccggagtatttccaaaaaaacagcatgcttctaaactgggcggatatttcaccgccgtctacgctgatgagcacgagaaacccacgctcatggaggaagaggaacgcggaaattttgagaaagctgaggtcgaaggcgaggcccaagagattgaatggcttccttttcgctgcattaaatgctttaagctatctttttcgaccgcagagctgctttgcatgcattatactgaccatcactctagagatctgaagcgtgatttcataatcttgggcaatggccctcgactccagaactcgacttaccagtgcaagcactgcgattccaaattgcagtctactgccgagctaactagccacctcaatatccacaatgaggaattccaaaagagagctaagaggcaggagagaagaaaacagctcttgtctaaacagaaatatgcagacggggcatttgccgattttaagcaggaacggccatttgggcacctggaggaggttccaaaaatcaaagaacggaaggtcgttggatacaaatgtaagttctgcgtggaggtgcaccccaccctcagggccatctgcaaccatctgcggaagcatgtacaatacgggaacgtgcctgctgtttcggccgcagtcaaagaggccgatgatcctgctcatctcttcttagacggcctggaagcagccaaagatgcttcgggagcactggtgggccgagttgatggcgaacactgtctcttggacggcatgctggaagacgagactaggcccggtggataccactgctctcagtgtgacagggtgttaatgtctatgcagggtctaagaagccacgagcgttcacatctggctcttgcgatgtttacaagggaagataagtatagttgtcagtactgcagcttcgtctccgccttcagacacaacttggacaggcatatgcagacacaccacggtcaccataagccattcagatgtaagctgtgctccttcaaaagttcgtacaacagccggcttaaaacgcacattctgaaagctcatgcaggagaacatgcctacaagtgcagctggtgcagcttttctacaatgacaatcagtcagcttaaagagcacagtcttaaagtgcacggcaaggccctaaccctgccacgccctcggatcgtcagcttactcagtagccatagccaccatagctctcaaaaggcgactcccgcagaagaggttgaggactccaacgacagcagctactctgagccacccgacgtccagcaacaattaaatcattaccagtctgctgcactcgcacgtaacaattctcgagtcagccctgtacctctgagtggcgctgccgcaggaacagaacagaaaacagaagccgttctgcattgcgaattttgcgagtttagctccggctacattcagagtatcaggaggcattaccgagataagcatgggggaaagaagctctttaaatgcaaagactgttctttttatacgggcttcaaatctgccttcacgatgcacgttgaggctgggcattccgccgtccccgaagagggaccgaaagacctgcgatgcccgctttgcctgtaccacaccaaatataaaaggaatatgatagaccacatcgtgctgcacagagaggagcgggtggtaccaatcgaggtgtgtcggtctaagctgtccaaatatctccagggagtcgtgttcaggtgtgataagtgcacatttacgtgttctagtgatgaatctttacagcagcacatcgagaagcacaatgaactcaagccctataaatgtcagctttgctattatgagacaaagcacaccgaggaacttgattctcatctccgggacgagcataaggtaagccggaacttcgaactcgtcggtcgagttaatcttgaccaattagagcagatgaaggagaagatggagagctccagctccgatgatgaggataaagaagaagagatgaacagtaaagccgaagatcgggagctgatgaggtttagtgaccatggtgctgctctgaacactgaaaaaaggttcccctgcgagttctgcggtagagcattttcccaaggatcagagtgggaacgacacgtccttaggcacgggatggccctcaatgacacgaaacaggttagtcgtgaggagatacatcctaaggagatcatggagaattccgttaaaatgccttccatcgaggagaaggaagatgatgaagcgattggaatcgacttctccctcaagaatgaaaccgtggccatttgcgttgtaactgcagacaaatccttattagagaacgccgaagctaaaaaggagta

SEQ ID NO: 25337 - DNA, 1392 bp, Artificial Sequence
  Description of Artificial Sequence: Synthetic coding sequence
atgcagacccatcacggccaccacaagccatttagatgcaagctctgtagtttcaagtcctcctataactctcgactcaagacacatattctgaaggcacacgcgggagaacacgcatataagtgctcatggtgctccttctctaccatgactatttcccagttgaaagagcactcgctcaaggtgcatggcaaggcacttactctgccaagacctcgcatagtttctctgctctcaagtcattctcaccatagctcacagaaggccaccccggcagaagaggtggaggacagcaatgacagcagctattctgagcctcctgatgtgcagcagcagcttaaccactatcagagtgctgcattagcccgaaacaacagccgggtgtccccggttcctttaagcggtgctgccgctggcaccgaacagaagacggaggctgtcctgcattgtgagttctgtgagttttcaagcgggtacatccagtctattcggcgtcactatcgcgataagcacggcggtaaaaaattatttaaatgcaaagactgctcattctataccggcttcaaatccgcgttcactatgcacgttgaggcgggtcatagtgccgtgcccgaggagggcccaaaggacctgcggtgtcccctgtgcctttaccacacgaagtacaagaggaatatgatcgatcacatcgtcttgcatagagaagagcgcgtcgtgcctatcgaggtgtgtcggtcaaaattatctaaatatttacagggggttgtgtttaggtgtgataagtgtactttcacatgtagtagtgacgagtcgctccaacagcacatcgagaagcacaatgaactgaaaccctacaagtgtcaactatgctattacgaaactaagcataccgaagaactggactcgcatctgcgggacgaacacaaggtgtctcgcaatttcgagcttgtgggacgcgtaaacctggatcagcttgagcagatgaaggaaaaaatggaatcttcaagctcagacgacgaggacaaggaagaggaaatgaactccaaagccgaggatcgtgaattgatgaggttcagcgaccacggggcagctctgaataccgagaaacggttcccctgcgaattttgcggcagggccttcagccagggaagcgaatgggaaaggcacgtcttgcggcacggaatggctctgaacgatactaagcaggtgtccagggaagaaatacatcctaaagagatcatggagaactctgtgaaaatgccaagcatcgaggaaaaggaggacgacgaggcaattgggatcgattttagcctgaagaatgaaaccgttgcaatctgcgtcgtgactgcagataagagcctgctggagaacgcagaggccaagaaagagtag

SEQ ID NO: 25338 - DNA, 1569 bp, Artificial Sequence
  Description of Artificial Sequence: Synthetic coding sequence
atggccttgccacagggcctgctcaccttcagggacgtggcaatcgaattctcccaagaagagtggaagtgcttagatcctgcacagcgtacactgtatcgagatgtgatgcttgagaactaccggaatctggtttcactcgacatctcaagtaaatgtatgctgaagacattatccagtacaggccaaggaaacacagaggtgattcacaccggcaccctgcataggcaagccagccatcatatcggtgaattctgcttccacgaaatcgagaaggacatacacgggttcgaattccaatggaaggaagacgagaccaatggacacgccgctcctatgacagagatcaaggaactggctggttcaactgggcagcatgaccagcgccacgccggaaataaacgaataaaagatcagcttggcagctcattccacctgcacttgcccgaaccacatatctttcaatccgaaggaaaaattggtaatcaggtggaaaagtctatcaacaacgcgtcttctgtgtctaccagccaacggatctgttgtaggcctaaaacacacatctctaacaaatacggaaacaattccctgcattcctccttgcttacacaaaagtgggaagtgcatatgcgagagaagtccttcgaatgtatacagagtttcaagtccttcaattgttccagcctgttgaagaaacaccagattattcacctggaggagaaacagtgtaaatgtgatgtatgcggcaaggtatttaatcagaaaaggtatctcgcgtgtcacaggaggtgccatacaggcgagaagccctacaaatgtaacgagtgcggcaagacatttgggcataattcgagcctgttcatccacaaggcactccacactggcgagaagccctatgagtgtgaggagtgcgacaaggtcttcagcaggaaaagccaccttgagaggcataagagaatccataccggcgagaaaccttacaagtgtaaggtgtgtgacgaggccttcgcttacaattcttaccttgctaagcacacgattttgcacaccggcgagaaaccatacacttgcaatgaatgcggaaaggtcttcaacagactgtcgaccctggccaggcatcatagactacataccggagagaaaccctataaatgtgaagaatgcgacaaagtgttttctcgaaagtctcacctggagcgccaccgacggatacatagcggcgagaagccatacaagtgcgaagaatgttgtaaagttttctcacgcaaatccaatctcgaaagacataggcggattcacactggcgagaagccttataaatgtaaggtgtgtgataaagcgtttcaacgcgactcccacctggcacaacatcagcgagtccacactggagagaaaccctacaaatgtaacgaatgtggaaaaacttttggacaaaccagctctttgatcatccataggcgactccacaccggcgagaaaccctataaatgtaacgaatgtgggaagaccttttcccagatgtccagcctggtgtatcaccatagactgcactccggggaaaaaccatag

SEQ ID NO: 25339 - DNA, 1410 bp, Artificial Sequence
  Description of Artificial Sequence: Synthetic coding sequence
atgctgaaaaccctgagctcaactggccagggcaacaccgaggtcatccataccggcacattgcataggcaggcaagccaccacatcggagaattctgctttcatgaaattgagaaggacattcacggcttcgagtttcagtggaaagaggatgaaactaatgggcatgctgcgcctatgacagagattaaagaactggccggttcaaccggccagcacgaccagcggcacgccggaaataaaaggataaaggaccagcttggctcctcattccatttacacctccctgaaccccatattttccagtctgagggaaaaatcggcaaccaagttgagaaatccatcaacaatgctagctctgtgtcaacaagtcagaggatctgctgtcgccctaagacacatatttctaacaaatatggcaataacagcctacatagcagcctgctgacacagaagtgggaggtgcacatgcgggaaaaatcttttgagtgcatccaatctttcaaaagttttaactgctcctccctcttaaagaagcatcagattattcatctggaagagaagcagtgtaaatgcgatgtgtgcggcaaggtgttcaaccagaagcgatacctggcatgtcacaggagatgccacaccggtgaaaagccttataaatgcaatgagtgcgggaagactttcgggcacaacagttcccttttcatacacaaagcgctgcacaccggcgagaaaccctatgagtgtgaggaatgtgataaggtcttcagtagaaagagccacctggaaagacataagcgtatacataccggggaaaaaccctataaatgtaaggtatgtgatgaagctttcgcatataattcttacctggccaaacacacaattttacacaccggggagaagccctatacttgcaacgagtgcggtaaggtcttcaacagactgagcaccttagcacggcaccatcgccttcacaccggcgaaaagccctataaatgcgaagaatgtgacaaagtttttagcaggaaatctcacctagaaagacataggagaatacacagcggagaaaaaccttataagtgcgaagaatgctgcaaggtcttttcaagaaagtctaatctcgaacgccatcggaggattcatactggcgagaagccctataagtgcaaagtctgcgacaaagcttttcagcgcgacagtcacctcgcccaacatcagagggtgcacactggcgaaaaaccatataagtgcaacgagtgtggcaagacgtttggtcagaccagcagcctcatcattcataggcgtctacacactggcgagaagccatataagtgcaatgagtgcgggaagacgttctcccagatgtcctctctggtctaccatcaccggctccacagcggtgaaaagccatag

SEQ ID NO: 25340 - DNA, 654 bp, Artificial Sequence
  Description of Artificial Sequence: Synthetic coding sequence
gtttttaatcagaagcgctatcttgcgtgtcaccggagatgccatactggagaaaagccctataagtgtaatgagtgtggtaagacatttgggcacaatagttctctctttattcacaaggccctgcacacgggagaaaagccatatgagtgcgaggaatgcgataaagtcttttctcggaaatctcacctcgagaggcacaaaagaattcatactggagaaaaaccatacaagtgtaaggtgtgcgatgaagccttcgcatataactcctatcttgccaagcacacaattctgcacacgggcgaaaaaccctatacttgcaacgagtgcggcaaggtgtttaatcgcctctctacactggcgcgacaccatcggctgcacacaggagagaaaccatataaatgcgaagagtgcgataaagtgttctcccggaagagccacttagagagacacagaagaattgtcgaacgcaatctcaccaacgtgaagaacgtggctaaattttctagccaaattaaacccggtaaaacccaggagttcatattggagcgcaatcacacgaatgtccgcttcgtcactaggctgtccaggggcatccatacatggcataatatccgagaattcattttggagaggaacctgacatctgtgtag

SEQ ID NO: 25341 - DNA, 1410 bp, Artificial Sequence
  Description of Artificial Sequence: Synthetic coding sequence
atgcttaaaacactgtccagtacaggccagggaaacacagaagttatccacaccggcactctccatcgacaggcgagccaccacatcggagagttttgtttccacgaaattgagaaggacattcatgggtttgagttccaatggaaagaggacgagaccaacggacacgctgcccctatgactgaaattaaggaactcgcgggaagcaccggacaacacgaccaaaggcacgccggaaacaaaaggattaaggatcagctaggctcatcttttcacctgcacttaccggagccgcatatatttcagagcgagggtaagattgggaaccaggtggagaagtcaataaataatgcttccagtgtctccacatcccagagaatctgctgccgacccaagacacacatatcgaataaatatggcaataattccttgcactcatccctactgacccagaagtgggaggtccatatgagagagaagagcttcgaatgcattcagagctttaagagttttaactgttcttcccttctgaagaagcaccagatcattcatctggaggagaaacaatgcaaatgtgacgtttgtggcaaggtctttaaccaaaaacggtatctcgcatgtcatcgtaggtgccacactggggaaaaaccgtataaatgtaatgagtgcggcaagacgttcggtcacaactcatctctgtttatccataaagcactgcatactggcgaaaaaccctatgaatgtgaagagtgcgacaaagttttcagcaggaaatcccacctggaaaggcacaaaagaattcatacaggcgagaagccgtataagtgcaaagtgtgcgacgaggctttcgcttacaactcttatctcgcgaaacatacaatcctgcacacgggagaaaagccatatacttgcaatgagtgcgggaaagtgtttaaccgactatctaccctggcgaggcaccatcggctccacactggggagaaaccatataagtgtgaggagtgcgataaagtctttagccggaagagccacctggaacgtcatcgccgaattcactcaggtgaaaagccatacaagtgcgaggagtgttgcaaggttttttccaggaagagcaacctggaacggcatagacggatccatacaggtgaaaagccatataagtgtaaggtgtgcgataaagcttttcagagagacagccatctggcgcagcaccagagagtgcacacaggcgaaaagccctataagtgtaatgagtgcgggaaaactttcgggcagaccagctctctcattatccatcgacggctccataccggggagaagccttacaaatgtaacgagtgtggcaaaacattttcgcagatgagctcactggtatatcaccaccggctccactcaggagagaaaccctag

SEQ ID NO: 25342 - DNA, 1569 bp, Artificial Sequence
  Description of Artificial Sequence: Synthetic coding sequence
atggcactacctcaaggcctcttgacatttagagacgtggcgattgagttcagccaggaagagtggaaatgcctggatcctgctcagcgtacactgtatcgggatgtcatgcttgagaattacagaaatctcgttagcctagatatatcatctaagtgcatgctgaaaaccctgtcaagtactgggcagggtaataccgaagtcattcatacaggtacgctgcatcggcaggccagtcatcacatcggagagttctgcttccatgaaatcgagaaggacatccacggctttgagttccagtggaaagaggacgagactaatggccacgcggctccgatgaccgagattaaggagctggctggtagtactgggcagcatgatcaacggcacgctgggaataagcggattaaagatcagttgggtagcagctttcatttgcatctccccgaaccacatatctttcagtcagagggaaagatcgggaatcaagtcgagaaaagcatcaataatgctagtagtgtcagtacttcacaacgcatctgttgtcggccaaaaacacacatcagcaataagtatggcaacaacagtctgcatagcagcttactgactcagaaatgggaagttcacatgcgagagaagtcttttgagtgcatccagagcttcaaatcattcaattgctcttcgctcctgaagaaacatcagattattcacctggaagagaagcaatgcaaatgcgatgtttgcggcaaagtgtttaaccaaaaacggtatttagcctgccaccggcgttgccatacaggagagaaaccgtacaaatgcaatgagtgcggcaaaacattcggccataacagctctctatttatccataaggccctccacacaggtgaaaaaccgtacgaatgcgaggaatgcgacaaagtattctcacgcaagtctcacctggagcgccacaaacgcatccataccggggaaaagccctataagtgtaaggtgtgcgatgaggcattcgcctacaatagctacctcgcgaagcacacaatcttacacaccggcgagaaaccctatacttgcaacgagtgtggcaaagtatttaatcggttaagcaccctggctcgccatcacagactgcataccggggagaagccctacaagtgcgaagaatgtgacaaggtattttccagaaaatctcatctggaacgccaccgcagaatccacagcggagagaagccttataaatgcgaagaatgctgcaaggtcttctcccgcaagagcaatctcgagcgacacaggcgaatccacacgggcgaaaaaccctacaaatgtaaagtctgcgacaaagccttccagcgcgattctcacctggctcagcatcagcgcgtacatactggggagaagccttataaatgcaacgagtgtggcaagacattcggacagacgtcttcgctgatcattcacagaagactccacacaggggaaaagccttataaatgtaatgaatgtggcaagacattcagtcagatgtccagtcttgtgtaccaccatcggttgcacagcggtgagaaaccttag

SEQ ID NO: 25343 - DNA, 2154 bp, Artificial Sequence
  Description of Artificial Sequence: Synthetic coding sequence
atgaaatcccaggaagaagtagaggtggcgggaattaagctgtgcaaggccatgtcactcggttccgtcactttcaccgatgtggccattgatttctcccaagacgaatgggagtggctcaatctcgcccagcgcagcctttataagaaggttatgctcgagaactaccggaacctcgtttcagtgggtttgtgcatttctaagccagacgtgatctctctcctggagcaagagaaagacccctgggtcatcaaggggggtatgaaccgtggactgtgtccagatctcgagtgtgtatgggtcacaaagtctttatccctgaatcaggacatctatgaggagaaattgcctcctgccatcatcatggagagactaaaatcctacgacctcgagtgctcgaccctgggcaagaactggaaatgcgaggacctctttgagagagagttggtcaaccagaagacccacttccgtcaggagacaataactcatatcgacactctgatcgaaaaacgggatcactctaacaaatcgggaaccgtcttccacctgaatactctctcttacataaagcagattttccctatggaggaacgaatcttcaactttcacactgataaaaagagcctcaaaacccattccgtagtaaagaaacataaacaagatcgcggtgagaagaagctattgaagtgcaatgactgcgaaaagattttttccaagattagcacattgactctgcaccaacgcatccacaccggagagaagccctacgagtgcatcgaatgtgggaaagccttcagccaaagcgcccatctggctcagcatcagaggatccacactggtgagaaacctttcgagtgcactgagtgcggcaaagcattttctcaaaacgcacacttggtacagcatcagcgtgtgcataccggggagaaaccctaccagtgtaagcagtgtaataaagcttttagccagctggctcacctggcgcaacaccagagagttcatactggcgagaagccttatgaatgcatcgagtgcggaaaggccttctctgactgctccagtctggctcaccaccggagaatccacacagggaaacgaccatatgaatgtattgactgtgggaaggcttttaggcaaaatgctagcttgattaggcatcgacggtattatcatacgggcgaaaagcctttcgactgtatagattgtggcaaagcctttaccgaccacattggtttaatacaacacaagcgcacgcatactggcgaaagaccatacaaatgcaacgtctgtggcaaggcctttagccacggttcctcgttgactgtccatcaacgcattcatactggagagaagccatacgagtgcaatatttgcgagaaggctttctctcataggggaagcctgacactgcaccagagagttcacaccggggagaaaccctatgaatgcaaggaatgtggaaaggcgtttcgtcaaagcacccatttagctcaccatcagagaatccatacaggagaaaaaccatacgagtgtaaggagtgctcaaagaccttttcccagaacgcacatctcgcacagcaccagaaaattcacaccggagaaaaaccctacgaatgcaaggagtgcggcaaggctttttctcagattgcacatttggtgcagcaccagcgcgtgcacaccggcgagaagccttatgaatgcattgagtgtggaaaggctttctcggatggctcatatctagttcagcaccagcggctgcactccggaaagcggccttatgagtgtttagaatgcggcaaggctttcaggcagcgcgcttctttaatctgccatcaaaggtgccacaccggtgaaaagccttacgagtgcaacgtgtgtggcaaggctttcagtcatcggaagtcactgactcttcatcaaaggattcacactggtgaaaagccgtacgaatgtaaggagtgcagcaaggcatttagtcaggtggctcacctcacactccacaaacgaattcatacaggtgaacgaccatacgagtgcaaggagtgtgggaaagccttcagacagtctgtgcatctggcccatcaccagcgcatccacaccggcgagtcttccgtgatcctaagctctgctctgccttatcatcaggtcttgtag

SEQ ID NO: 25344 - DNA, 2154 bp, Artificial Sequence
  Description of Artificial Sequence: Synthetic coding sequence
atgaagtcccaggaggaggtggaagtggctggaattaaactttgtaaagccatgagtcttggctctgtaactttcacagacgtcgcgatagacttcagccaggacgagtgggagtggctcaacttggcgcaaagatccttgtacaaaaaggtgatgctcgagaactaccggaacctggtgagtgtcggattgtgtatttccaagcctgatgtgatctctctgcttgaacaagagaaagatccatgggtgatcaagggcggtatgaatagggggttatgtcccgacctcgaatgtgtgtgggtcacaaaatcactgagtctcaaccaggacatttacgaggaaaaactcccaccagccatcatcatggaaaggctgaaatcttatgacctcgaatgcagtacattaggtaagaattggaaatgcgaggatctttttgagcgcgagctcgttaaccagaagacccattttagacaggaaaccatcactcacatcgatacactcattgagaagagggatcactcgaacaagagcgggactgttttccatttaaatacactgtcttacatcaaacagatatttcctatggaagaacgcatattcaatttccataccgacaaaaagtccctaaagacccattcagttgtgaagaaacataaacaagaccgtggggaaaagaaactgctaaaatgtaacgactgtgagaagatcttttccaaaatctcaacactgaccttgcatcaaagaatccataccggcgaaaagccttatgagtgcatcgagtgtggcaaagccttctctcagagtgctcatctcgcacagcatcaacgcatccatactggggaaaaacctttcgaatgcaccgaatgcgggaaggctttctcccagaatgctcacttagtgcagcatcagcgagtgcacactggggaaaagccataccaatgcaagcaatgtaataaggccttcagtcaactggctcacctggcacaacatcaacgagttcataccggcgagaagccatatgagtgtatagagtgtggaaaggctttctcagactgcagtagcttagcccatcataggcgcatacacacagggaagagaccttatgaatgtattgattgtggaaaggcatttcgccaaaacgcctctttgattcgacatcgtagatactaccatacgggggaaaagcccttcgactgcatcgactgcgggaaggcatttacagatcacattggattgatccagcacaagcgcactcacacaggggagcgaccatacaagtgtaacgtgtgtggcaaggccttttcgcacggctcgtctctcaccgtgcatcagagaattcacacgggggagaagccgtacgaatgtaacatctgtgagaaggcattttcccatcggggatcccttaccctccatcagcgggtgcacacgggggaaaaaccctatgaatgtaaagagtgtggaaaggccttccgccagagcacacatttggcacaccaccagagaatccacaccggagaaaaaccctacgagtgcaaagagtgctccaaaacgttctcacaaaacgctcatctcgctcaacatcaaaagatccacactggggaaaaaccatatgaatgcaaggaatgtggcaaagcgttcagtcaaatcgcacatctagtgcaacatcagagggtgcacacgggggagaaaccttatgaatgcattgagtgtggtaaggccttctctgacgggagctatttggtgcagcatcagagactccactccggcaagcgtccctatgagtgtctggagtgcggtaaggcctttcgccaacgagcttcattaatttgtcaccagcgctgccacacaggggaaaagccgtacgaatgcaatgtctgtggcaaggctttctcgcacaggaaatccctcacactgcaccaacggatccataccggagaaaagccatacgaatgcaaggagtgctccaaggccttctcgcaggtggctcacctgacgttacacaaacgaatccatacaggggagcgcccatatgagtgcaaggaatgtggtaaggccttcagacagagtgtgcatcttgcacaccaccagcggattcacacgggagagtcctccgtaattctgtcttccgcccttccataccatcaggtgttatag

SEQ ID NO: 25345 - DNA, 1881 bp, Artificial Sequence
  Description of Artificial Sequence: Synthetic coding sequence
atgaacgtggaagtagttaaggttatgccgcaagatctagtgacattcaaggatgtcgctattgattttagccaggaggaatggcagtggatgaacccagcacagaagcgattgtatcggagcatgatgctcgaaaactaccaaagtttggtgtcactaggcctttgtattagcaagccgtacgtgatcagcctgttggaacagggaagggaaccatgggaaatgacaagcgagatgaccaggagtcccttttcagattgggagtcaatttatgtgacgcaggaattaccgcttaaacagttcatgtacgatgacgcatgcatggaggggataacttcttatggtcttgagtgttccactttcgaggagaactggaaatgggaggacttgttcgagaagcagatggggtcccatgagatgtttagcaagaaggagattatcacacacaaggaaacgataactaaagagaccgagttcaagtacactaagttcggaaagtgtatccatctggagaacatagaggaatctatctataatcacacttcggataaaaagtcattttcgaagaactcaatggtgattaagcacaagaaggtttacgtgggtaagaagctcttcaagtgcaatgagtgtgataaaacatttacacatagctcatccttaacggtgcattttcggatccacacaggggagaagccctatgcctgcgaggagtgcggcaaagctttcaaacagaggcaacacctcgcccagcaccatcgaactcacacaggagagaagctgtttgaatgtaaagagtgtcggaaagcatttaagcagtccgagcatcttattcagcaccagagaattcatacgggggaaaaaccctacaaatgcaaggagtgcagaaaagcctttcggcagcccgcacacctagcccagcaccaaagaatccataccggcgagaagccctatgaatgcaaggagtgcggcaaggcttttagcgatgggagctctttcgctagacatcagaggtgtcatacagggaagaggccatacgaatgcatcgaatgcggcaaggcatttagatacaacacatccttcattcgccactggcggagctatcacacaggagagaaacctttcaattgtatcgattgcggcaaagcattcagcgtgcacatcggactcatcctgcaccggaggatccacacaggggaaaaaccctacaagtgtggagtgtgtggaaaaaccttttcttccggctcctctcggaccgtccatcaacggatccatacaggagagaagccgtacgaatgtgatatttgtggtaaggacttttcccaccatgcaagtctcacgcagcatcaacgggtgcattccggcgaaaagccatacgagtgcaaggaatgcgggaaggccttcaggcagaacgtgcaccttgtatcgcacctccgaatccacacaggcgagaagccgtacgagtgtaaggaatgcggcaaagctttccgcatctcctcccagctagccactcaccagcggattcatacaggggaaaagccgtacgagtgtatcgaatgtggtaatgccttcaagcagcgaagccacctggcacagcatcaaaagacgcatactggtgaaaaaccttatgagtgtaatgaatgcggcaaggccttttcgcaaacgtcaaacttgactcagcaccagcggatccataccggtgagaagccatacaagtgcactgaatgcggtaaggcctttagtgactcatcaagctgcgctcagcatcaacgcttgcatactggtcaaagaccctaccagtgctttgagtgcgggaaggcctttcggaggaagcttagtctgatctgccaccagaggtcccacacgggcgaagaaccctag

SEQ ID NO: 25346 - DNA, 2616 bp, Artificial Sequence
  Description of Artificial Sequence: Synthetic coding sequence
atggctgaagagtttgttacgctgaaggacgtgggtatggactttacccttggggactgggaacaactgggtctcgagcagggcgacaccttttgggataccgcactggacaattgccaggatctgtttttgctcgaccccccaaggccaaacctcacgagtcatccagatggtagcgaagacctggagccgttggctggtggctcccctgaggcgaccagtccagacgtgacagagactaaaaattctccactcatggaagacttttttgaggaaggctttagtcaggagataattgaaatgctgagcaaagacggcttctggaactccaacttcggagaagcatgcatcgaggacacatggctcgactctctgctgggggaccctgaatctttgctaagatcagacatcgccacaaatggagagagcccaacagaatgcaagtcccacgagctcaagcgtggactgagcccagtttctacagtgtctaccggcgaggactcaatggtgcacaacgtgtccgagaaaactctcacccccgctaagagcaaggagtatcgaggcgagttcttctcttattcagaccacagccaacaggactccgtgcaggaaggagagaaaccctatcagtgcagtgaatgcgggaagtcattttctggctcctataggctaacgcaacattggattacacacaccagggaaaaacccacagttcatcaggagtgtgaacaagggtttgatagaaacgcaagcctttcagtgtatccgaagacccatacgggctacaagttctacgtttgcaacgaatacggtacaaccttttcgcaaagtacttacctgtggcaccagaagacccatacaggcgagaaaccctgtaaatcccaggatagtgaccaccctcccagtcacgacacccaaccgggtgagcaccaaaagacccatacagactctaaaagctacaactgcaatgaatgcgggaaggcattcactaggatatttcacctcactcgacatcagaaaatacacacacggaaacgctatgagtgttctaaatgccaagccacttttaaccttagaaaacacttgatccagcaccaaaaaactcatgccgcaaagacaacaagtgagtgccaggaatgcggtaaaatcttccgccacagttcgctcttaatagagcatcaggctctgcatgcaggggaagaaccttataagtgcaatgagagggggaagtcctttcgccataactctaccttaaagatccatcaaagagttcactctggcgagaagccgtataaatgttcagagtgcgggaaggcattccacaggcacactcatctcaacgaacatcggagaatacacaccggctacagaccccataagtgtcaggaatgcgtgaggagctttagccgtcccagtcacctgatgcgccaccaagccattcacactgcagaaaagccttactcgtgtgctgagtgcaaggagaccttcagcgataacaacagactggtacagcaccagaaaatgcacaccgtaaaaaccccctacgagtgtcaggagtgcggggaacgctttatttgcggaagtacgctgaagtgccatgagtctgtgcatgcgcgtgagaaacagggctttttcgtgtcgggcaagattctcgatcagaatcccgagcagaaagagaaatgttttaagtgtaacaagtgtgaaaaaacattcagctgcagtaagtacttaacccagcacgagcgaattcacacgaggggcgttaagcctttcgagtgtgatcagtgcggaaaggcctttgggcaaagtacccgtctaattcaccaccaacggatccattcccgggtgcgactgtacaaatggggagagcagggcaaggccatctcgtccgccagcctcatcaagctgcaatcttttcacaccaaggaacatccttttaagtgcaacgagtgtggaaaaacgttttcacatagtgctcacctgagcaagcaccaattgatccatgctggcgagaacccatttaaatgcagcaagtgtgatcgcgtgtttacccagaggaactacctggttcagcacgagcggactcacgcccgtaaaaaacccctggtgtgcaatgaatgcggcaaaacttttaggcagtcctcttgtctatctaagcaccaacgcattcacagcggggaaaaaccatacgtttgcgactattgcggaaaggcattcggccttagtgctgagctggtcaggcatcagagaatccacacaggcgagaaaccttatgtctgccaagaatgcggcaaggcttttacacagtcaagctgcctgtctattcaccggcgagtgcataccggggagaaaccatatcggtgcggcgagtgcggcaaagccttcgcccagaaggctaatctgacccagcaccagaggatccacacaggagaaaagccctacagttgcaacgtttgcggaaaggcattcgtgctgagcgcacacctcaaccagcacctccgtgtacacacgcaggaaaccctgtaccagtgccagaggtgccagaaagctttccggtgccatagttcgcttagccggcatcagagggtacacaataaacagcagtactgcctatag

SEQ ID NO: 25347 - DNA, 2616 bp, Artificial Sequence
  Description of Artificial Sequence: Synthetic coding sequence
atggccgaagaattcgtaacattgaaggatgtgggcatggactttacgctcggagactgggaacaactaggcctcgaacagggcgataccttttgggacaccgccctggataattgtcaagacctcttcctgctagatccacccagacctaacctgacctcacaccctgatggctccgaggatttagagcccctcgccggaggctcacctgaagccacgtcccccgacgtaactgaaaccaagaactcccctctgatggaagatttttttgaggagggattttctcaggagattatcgaaatgttaagtaaagatgggttctggaacagcaatttcggtgaggcctgtatcgaggacacctggctcgactcactgctgggggaccccgaaagcctgctgaggagcgacatagccactaatggtgaaagccccaccgagtgcaagtctcatgagctgaagcgaggcctttctcctgtgagcacggtcagcaccggggaagactcaatggtgcacaatgtgtctgagaagactttgacaccagctaaatccaaggaatatcgaggcgagtttttttcttatagcgaccattctcagcaagactctgtgcaggagggcgaaaagccgtatcagtgctccgaatgtggaaagtcattctccggttcctacaggctgactcagcactggattactcacaccagagagaagcccactgtccatcaagagtgtgagcaggggtttgataggaatgcaagcttaagcgtgtacccaaagacccacaccgggtacaagttctacgtctgtaacgaatatggcacaactttctctcagagcacttacctgtggcatcagaaaacacatacaggcgagaaaccttgcaaaagtcaggactcagatcacccgccatcgcatgacacacagcctggagagcaccagaaaacccacaccgatagtaaaagctacaattgtaacgagtgcggcaaggcctttacacgcattttccacctcaccagacaccagaagatccacacacgaaaaaggtacgaatgttccaagtgccaagccactttcaacctgcgaaagcacctaatccagcaccaaaagacccacgccgctaagaccacgtcagaatgccaggagtgcgggaagatctttcggcatagctccctcctaattgagcaccaggccttacatgcaggagaggaaccatacaaatgtaatgagcgaggcaagtcctttagacataatagcacgctcaagatccatcagagagtccatagcggcgaaaaaccctacaaatgttcagaatgtgggaaggcatttcatagacatacacatctgaatgagcatcgacgcatccacacagggtacaggccacacaagtgccaggagtgcgtgagatcattttcccgcccttcacacttaatgcggcaccaggcgatccacactgccgagaagccgtatagctgcgccgagtgtaaagagaccttctctgataataatagactggtacagcatcaaaagatgcacaccgtgaagacaccatacgagtgccaggagtgcggcgagagattcatatgcggctcaacgcttaagtgtcatgagagtgtccatgcgagggagaaacaagggttttttgtctctggcaagatcctagatcaaaatccagaacagaaagagaaatgcttcaagtgcaataagtgtgagaagacgttttcctgctccaagtatctcacccaacacgaaagaattcatacccgtggggtgaaaccttttgagtgtgatcagtgcgggaaggctttcgggcaatcaactcgactgatacaccaccaaagaatccactcgagagttcggttgtataaatggggcgaacagggcaaggccatttcgtcggccagtctgataaaactccagtccttccacacgaaggaacacccttttaagtgcaatgagtgcggcaagaccttcagccatagtgctcacttgagtaaacaccagttgattcacgcaggcgaaaacccttttaagtgttcaaaatgcgaccgggtttttactcagcggaattacttagtgcagcatgagagaacccatgcgagaaaaaaacctctagtctgtaacgagtgtgggaagacttttagacaatctagctgcttgtctaaacaccagcgcattcattcaggcgagaagccctacgtgtgtgattattgcggcaaagcattcggcctctccgccgaactcgttcgacatcaacgtatccatacaggcgagaagccttacgtctgccaggaatgtgggaaggcgttcactcagtcaagctgtctctccatccatcgccgtgtgcatactggggaaaaaccgtatagatgcggagagtgtggaaaagccttcgctcagaaagctaacttaactcagcaccagcggatccatacgggagagaagccttatagctgcaatgtgtgcgggaaggcatttgttttatctgcccatctgaaccagcaccttcgcgttcatacacaggaaaccctctatcagtgccagagatgtcagaaggcttttaggtgtcactccagtctctcccgccaccaacgcgtgcacaacaaacagcagtactgtctgtag

SEQ ID NO: 25348 - DNA, 2580 bp, Artificial Sequence
  Description of Artificial Sequence: Synthetic coding sequence
atggactttacattgggggactgggaacaacttggcttagagcagggggacaccttctgggacaccgctctagataactgccaggacctatttttactcgaccccccacgccctaacctgacaagccacccagatggctcggaggatttggagccactggctggaggaagtccggaagcaacctccccagacgtgaccgagaccaaaaacagtccccttatggaagacttcttcgaggaagggttttcccaagaaatcattgaaatgctaagcaaagatggcttttggaactctaacttcggggaagcatgcattgaggacacctggttagattctttgctgggtgatcctgagtctctacttcggagtgacatcgctacaaatggagagagccccacggaatgcaagagtcacgaactgaagcgcggactcagccctgtgtcaacagtgagcaccggcgaagattccatggtccacaacgtgagcgagaagacgcttaccccagcaaaatcgaaagaataccgaggcgagtttttctcatacagtgaccactcgcagcaagatagcgttcaggaaggagagaagccctatcagtgttccgaatgtggcaagagtttcagtggcagttaccggctaactcagcactggattacccacacccgcgagaagccaaccgtccaccaggagtgcgagcagggcttcgacaggaacgcatcactctcagtctatcccaaaactcatacaggttacaaattttatgtttgcaacgagtacggcacaactttctcgcagtccacgtatctgtggcatcagaagacccatacaggtgagaaaccctgcaagagccaggatagtgatcacccaccaagccatgatacccagccaggcgagcaccagaagacacacaccgattcaaagtcttataattgtaacgagtgtggaaaagcatttactcgcatatttcatctcactcgacaccagaagattcacactcgcaaaaggtatgaatgttccaagtgtcaggctacgtttaacctccggaaacatctcatccagcaccagaagactcacgcagcaaagactaccagtgaatgtcaggaatgtggcaaaattttccggcatagctcgctactcatcgagcatcaagctctccatgccggtgaggagccctacaagtgcaacgagcggggaaagtcatttaggcataactcaaccctgaaaatccaccaaagggtccattcaggcgagaaaccttacaagtgctcagagtgcgggaaggcttttcaccgacatactcacctcaatgaacaccggagaatccacaccgggtacaggcctcacaaatgtcaagaatgtgttcgctcattctcaaggccaagccatctgatgagacatcaggccattcacaccgccgaaaaaccttacagctgcgcggaatgcaaggagacatttagcgacaataatagactcgtgcaacaccagaaaatgcacactgttaaaacgccgtacgaatgtcaggagtgtggcgagagattcatctgcgggtcgaccctgaagtgccacgaatcagtgcacgccagggagaaacagggcttctttgtgtccggtaagattctggatcagaaccccgagcagaaggagaaatgctttaaatgcaataagtgcgagaaaactttttcctgctctaagtacctgacgcaacacgagcgcatccatacacgaggcgtcaagccattcgagtgcgatcagtgcggaaaggctttcggacagtccacacgattaatccaccaccagagaatacactccagggtgaggctgtacaaatggggtgagcaaggcaaagccatttcttcagcttctcttatcaagctgcaatcgttccacacgaaggagcacccattcaaatgcaacgaatgcggcaagacgttttctcacagtgctcacctgtcaaagcatcagctgatccacgccggtgagaacccattcaagtgctctaaatgcgatagggtcttcacccaaaggaattatctagttcagcacgagcgaacacatgcacgcaaaaaaccgctggtctgcaatgaatgcggaaaaacattccggcagtcctcatgcttaagtaagcaccagcgcatccatagcggggaaaagccatatgtgtgtgactactgtgggaaggctttcggactgtctgccgagttggtgagacaccagagaatccacactggggaaaagccttacgtttgtcaggaatgcgggaaggcctttacgcaaagcagctgtttgtcaatccaccgaagggttcacacaggggagaaaccttatagatgcggcgagtgcggaaaagcattcgcgcagaaggcgaaccttacccagcatcagcgcatccacacaggcgaaaagccctactcctgcaatgtgtgtggaaaagcattcgtgctgagcgcgcacctgaatcagcacctgcgggtgcacacccaggaaacactgtatcagtgccaacgttgccagaaagcctttagatgccattctagcctctcaagacatcagcgggtgcataataaacagcaatattgcctgtag

SEQ ID NO: 25349 - DNA, 2616 bp, Artificial Sequence
  Description of Artificial Sequence: Synthetic coding sequence
atggctgaggaattcgtgaccctgaaggatgtaggcatggatttcaccctgggggattgggagcagctggggttagaacaaggggataccttttgggatacagccctggacaattgtcaagacttgttcctcttggaccctcctcgtcctaatctgacctcccaccccgacggtagtgaagaccttgaacctctggccggaggctcacccgaagccacgtctcctgacgttacagagacgaaaaactcacccctgatggaggatttcttcgaggagggtttctcacaggaaatcattgagatgctctcaaaggatgggttttggaactcaaacttcggggaagcttgcattgaggacacttggctggactccctcctaggcgaccccgagtctctgcttcgctcagatatcgctactaacggagaaagccctacggaatgtaagagccacgaattaaaaagaggcctgtcccccgtgagtactgttagcaccggcgaagattccatggttcataacgtctccgaaaagactctgaccccggcaaagtctaaggaatatcgcggagagtttttttcttactctgaccactcgcagcaagactccgtgcaggagggcgaaaaaccttaccaatgctctgaatgcgggaagtctttctcaggctcgtacagactgacacagcactggatcacgcacacacgcgaaaaacccacggttcaccaggagtgtgagcagggctttgaccgcaatgcgagcctgagtgtgtatccgaaaactcacaccgggtacaaattttatgtttgtaatgagtatggtacgactttttctcaatccacttatctgtggcaccagaagactcataccggagagaagccttgcaagtctcaggactccgatcaccctcctagccatgatacgcagcccggagaacatcagaagacccacacagattccaagtcatacaactgtaatgaatgcggaaaggccttcacaaggattttccatctgaccaggcatcagaaaattcataccaggaagaggtatgaatgctccaagtgtcaggctacctttaatctgagaaagcatctcattcagcatcaaaagacgcatgccgctaagactaccagcgaatgtcaggagtgcggcaaaatttttagacactcgtctctcctgatcgaacatcaagcgcttcacgctggcgaagagccttacaaatgtaacgaacgtggaaagtctttcaggcataactcgacgctcaaaattcatcaacgggtgcatagcggggaaaagccgtacaaatgcagcgaatgcggaaaagcctttcatcggcacactcatctgaacgagcacaggaggatacatactggttaccgtcctcacaagtgccaggaatgcgtcagatccttctcaaggccttctcatctgatgcggcatcaggcgattcacaccgcagaaaaaccgtatagttgcgcagagtgtaaggagaccttctcagacaataatagactggtgcagcaccagaagatgcataccgttaaaaccccttatgagtgtcaggaatgtggggaaaggttcatctgcgggtccaccctcaagtgtcatgagtctgtgcacgcccgagaaaagcaggggttcttcgtctcaggcaagatcttagaccagaaccctgaacaaaaggaaaagtgttttaaatgcaacaagtgtgagaagactttttcctgttcaaagtacctgactcagcacgagagaattcacacaagaggggtcaaacccttcgaatgcgaccaatgcggcaaagccttcgggcagagcacccgcctcatccatcatcagagaatccactctagggtcagactctataaatggggggagcagggaaaagcgatttctagcgccagcttgatcaagctccagtctttccacactaaagaacatccttttaagtgcaacgagtgtggtaaaacatttagtcactcagcacacctttccaagcaccaacttatccatgccggagagaacccgttcaagtgcagtaaatgcgatagagtcttcacacagaggaattatctggtgcaacacgagcgcacccacgcgcgaaagaaacctctggtttgtaatgaatgcgggaagaccttccggcagtcttcctgtctgtctaaacaccagcgtatccatagcggcgaaaaaccctatgtgtgtgattactgcggcaaagccttcggattgagtgcggaactggttcgacatcagagaatacacacaggcgagaagccttatgtttgccaagagtgcggcaaagcttttacacaaagttcatgtctctctatccaccgcagggtgcacaccggcgagaaaccataccggtgcggcgagtgtggaaaggcatttgcgcagaaagccaatctgactcagcaccagcgaatccacacgggcgagaaaccgtactcatgcaatgtgtgcgggaaagccttcgtgctatcggcccatctcaaccagcacctgcgggtgcacacgcaagaaaccctgtaccaatgtcaacgatgtcaaaaggcttttcggtgtcacagtagtctatcccggcaccagcgagtgcataacaaacagcagtactgtttatag

SEQ ID NO: 25350 - DNA, 1575 bp, Artificial Sequence
  Description of Artificial Sequence: Synthetic coding sequence
atggccaagcgacctggtccaccaggctcccgcgaaatgggacttctgacctttagggacattgccatcgaattcagtcttgaggagtggcagtgtcttgactgcgcccagagaaacctgtacagggacgtgatgctggagaattacaggaatctcgttagcctgggtatagcggtcagcaagcccgacctcatcacatgcctggagcaaaataaggagtcgcaaaatattaagagaaacgaaatggtagccaaacatcctgtcacccgaagtcacttcacccaggatctacagcccgaacaagggattaaggacagccttcagaaggtcatacccagaacctacgggaaatgcggtcacgagaaattgcagttcaaaaaatgctgtaagtccgtgggagagtacgaagtgcacaagggaggatattcagaggtgaatcaatgtctaagcaccacccagaacaagatctttcaaactcataagtatgttaaggttttcggcaagttctccaacagcaaccgtgataagacccgctacactggaaataaacacttcaaatgcaataagtacggtaaatctttctgtatgctttcgcaccttaatcaacatcaagtcattcacacgcgcgagaaatcctacaagtgtaaagagtgtgggaagtcctttaactgctctagcaatcacacgacacataagattatacacacaggtgaaaagccctaccggtgcgaggaatgcggaaaggccttctcctggtccgccaacctaacaaggcataagcgcacacatactggagagaaaccttatacctgtgaagaatgtggacaggcttttcggagaagctctgcgctaactaatcacaagaggatccatacaggcgagcggccttataagtgtgaggaatgcgggaaagcattttctgtgtcttccacactgacagatcacaagcggatacacacgggcgagaaaccctgccggtgcgaggaatgcggaaaggccttctcttggtcctccaaccttactcgtcataagcgcattcatacaagggagaagccatacgcctgcgaagaatgcgggcaagctttctccctgtcgtctaatttgatgcgtcacagacgcatccatactggagaaaagccctacacttgcgaagaatgtggacaggacttcagacggagctcagctctgacaatccataaacggatacacacgggagagcgtccctataagtgcgaggagtgcgggaaagtcttctccctgagctccacgctgactgaccacaagcgcatccacaccggagagcgcccatacaaatgcgaggagtgcggtaaagcattcagcctgagttcaacactgactgatcacaagagaatccatacaggtgaacgcccttacacatgcgaggagtgcggtaaggcgtttaactgctctagtaccctgatgcaacacaagcgtattcatacaggggagaagccatacaagtgtgaggagtgtgagcaggcattcaagtggcatagctcccttgctaaacacaaaattattcacaccggagagaaaccttacaagtgcgagtag

SEQ ID NO: 25351 - DNA, 1857 bp, Artificial Sequence
  Description of Artificial Sequence: Synthetic coding sequence
atggaacgtgcagtggagccctggggccctgacctccacaggccagaagaacgcgaaccccagaggggggctaggacaggtctagggagcgagaacgtgataagccagcctaacgagttcgagcacacaccacaggaggacgatttgggattcaaggaagaggacctggccccagaccacgaagtaggtaacgcttcactgaagcccgaggggatccagaattgggatgatctgtgggtgcagcgtgaaggactgggcaagcctcagcccagggatagaggccctagactgcttggagaaccacgttggggacaagcctcatctgatcgggctgccgtatgcggggaatgcggcaagtcattccggcagatgtctgatctggtgaagcatcaaagaacacataccggcgagaaaccctataagtgtggggtgtgtggtaaaggttttggggactcaagcgccaggattaaacatcagcgcacacatagcggcgagaaaccttaccgggctaggcccccagcgcaaggcccacccaagataccccgttcccgcatccctgccggtgaaaggccgactatttgcggtgaatgcggaaaaagctttagacagtcatctgatttggtgaaacatcaacgcacacacaccggcgagaaaccttacaagtgcggcatatgcggtaagggcttcggagattcatccgccagaatcaaacatcagcggacccaccggggtgaacagccacctcgccctgtagtccctagaagacagccttcccgtgccgcaacggcggctactcagggccctaaagcccaggacaagccgtatatttgtaccgactgcggcaagagatttgtgttgtcctgcagtttgctgagccatcagagatcacatttagggccaaaaccctttggatgcgacgtatgcggaaaggagttcgctcgcggaagcgatctagtcaagcatctgagggtgcacactggagagaagccatatctgtgccccgagtgcgggaaaggtttcgctgattcctctgcccgtgttaagcatcttcgcacgcatagcggagagcggcctcacgcctgtccagaatgtgacagaactttttcgctcagctctacgctgctgagacaccgcctgactcatatggagccccaggatttcagctttccgggataccctcttccggctctcattccctcacccccacccccaccactcgggacatctcccccacttactcccaggtcaccttcccattctggagagcccttcgggttgcccggattggagccggaaccgggaggaccccaggccggagaaccaccgcctcccctggccggtgacaaaccacataagtgcccggaatgtggaaaagggtttagacgtagttccgatttggtgaagcatcacagggttcacacaggcgaaaaaccttatctttgcccagagtgtggaaaaggattcgcggactcatcggctcgtgttaagcatctccgcactcaccgcggagagcgggcacgccctccccctccctcaacactccttcgccctcacaatcctcccggtcccgtgcccatggcccctcggcctagagttagagcacaaccatcaggcccttcacaacctcatgtctgtggcttttgtggaaaggagttccctagaagctcggacctggtgaagcaccgcagaacgcataccggcgagaaaccgtataaatgcgccgagtgtggaaagggattcggcgacagttccgccaggattaagcaccaaaggggacatcttgtgttgacacccttcgggatcggcgatggtcgcgcacgaccgctcaagcaggaagccgcaacagggctggagtag

SEQ ID NO: 25352 - DNA, 432 bp, Artificial Sequence
  Description of Artificial Sequence: Synthetic coding sequence
atggaacgagcagtagaaccatggggtcccgatcttcacagaccggaggagcgtgaaccgcagcggggagcacggacaggactcggctccgaaaacgttatttcgcaaccaaatgaattcgaacacaccccgcaggaggatgacctggggtttaaggaggaagacttagctcctgatcacgaggtgggcaatgccagcctcaagcctgagggcatacagaactgggacgatctgtgggtgcagcgcgagggactgggcaagccacaacctcgtgatcggggtcctcgtctgttaggtgagcccagatggggacaggcatctagcgatagggccgctgtgtgtggagaatgtggaaaaagcttcagacagatgtctgacctagtcaagcaccagagaactcatacaggcgagaagccctataaatgtgggtag

SEQ ID NO: 25353 - DNA, 444 bp, Artificial Sequence
  Description of Artificial Sequence: Synthetic coding sequence
atggagagagcagtggagccctggggcccagaccttcaccgaccggaagagagggagccgcaacggggagcccgaactgggctcggtagcgagaacgtgatctctcagccgaatgaattcgagcacaccccgcaggaggatgatctcggcttcaaggaagaggaccttgcccctgatcacgaagtaggcaatgcctccctcaagcctgaaggcatacagaattgggacgacctgtgggtccagcgggagggactagggaaaccacagcctcgtgacaggggaccccgtctgctgggtgagcccagatggggccaggccagctcagatcgggcagctgtctgcggcgagtgcggtaagtcatttcgccagatgtcggatctggttaagcaccagaggactcacaccggagagaagccctataaatgtggtgtgtgtggtaaatag

SEQ ID NO: 25354 - DNA, 2235 bp, Artificial Sequence
  Description of Artificial Sequence: Synthetic coding sequence
atgcaagcggtggtgccactgaataagatgaccgctatctcccctgaacctcagactctggcttccacggaacagaacgaggttccaagagtggttacatctggtgagcaggaggccatcctgagggggaacgcagcggatgccgagtcattccggcagaggtttcgctggttttgctattctgaggtcgccggaccgagaaaagctctttcacagctgtgggaactctgcaaccaatggcttcgaccggacatccacaccaaagagcagattctggaactgttagtcttcgagcagttcctgacaattctgcccggagagatcagaatctgggttaaaagccagcatcccgagtcatctgaggaagttgtgaccctgattgaagatctgacacagatgctcgaagagaaagatcctgtgagtcaggacagcacggttagtcaggaagagaactcgaaagaggataaaatggtaacagtgtgccctaacacagagtcctgcgaatctatcactctcaaggatgtggcagtgaatttctctcgtggagaatggaaaaagctcgagccgttccagaaagaactgtacaaagaggtactcctggagaacctgaggaacctagagttcttagattttccggtctccaagctggagcttatttcgcagctgaagtgggtggagttgccatggcttctcgaggaagtttctaaaagtagcaggctcgacgagagcgcacttgacaaaatcatcgaaagatgcctgcgcgatgatgatcatgggcttatggaagaatctcaacagtactgcggctcttcagaggaagatcacggcaatcaagggaatagcaaaggcagagtggcgcaaaataagacgctgggaagcggttctcgtggcaaaaaattcgaccccgacaagagtccctttgggcataatttcaaagaaaccagcgatctgatcaagcatctgcgcgtatacctgcgcaagaaaagcagaaggtacaacgagagcaaaaagcccttttcttttcactcagatctcgtattaaaccgcaaggaaaaaaccgccggagagaaatcacggaagtctaatgacggcggtaaggtcctcagccacagctccgcgctaaccgagcaccagaagcgccagaaaattcacctgggcgatcgcagtcagaagtgcagcaaatgcggtattatcttcattcgcaggagcacactaagtcggagaaagactccgatgtgcgagaaatgccgcaaagatagttgtcaggaagctgccctgaacaaagatgagggaaatgaatcaggcgaaaagacccataaatgctctaaatgcggcaaggccttcggatactccgcctccctgacaaagcacagacgcattcacacaggagagaagccatatatgtgtaatgaatgcggaaaggccttctccgactccagtagcctaaccccgcaccaccgaacacacagcggcgagaaaccgtttaaatgcgacgattgtgggaagggcttcaccctctcagctcaccttataaagcatcaacggattcacactggtgaaaagccatacaaatgtaaggattgtgggcgtccattttctgacagcagttcactgatccaacaccaacgcattcacacaggcgaaaagccatacacatgcagcaactgtggaaagtcattttcacatagcagctccctgagtaagcaccagaggattcacacaggcgagaagccctacaaatgtggagagtgcggcaaagcgtttcggcagaacagctgcctgacacggcaccagcggatacacaccggagaaaagccttacctctgcaatgattgtgggatgactttttcacatttcaccagtgtgatttatcaccaacgtctgcactctggtgaaaagccttataagtgtaaccaatgcgagaaggccttcccgacccactctctgctttctcgacaccaaaggatccatactggggtgaaaccctacaaatgcaaggagtgcggaaaatcgttttctcagtcatcctcccttaacgagcaccaccgcattcacaccggcgagaaaccctatgagtgtaattactgcggtgctacattcagtcggagtagcattctggtggagcatctgaaaattcacaccggtagacgagagtatgaatgcaacgagtgtgagaaaacttttaaaagtaactccggcttgataaggcatcgagggttccactcggcagaatag

SEQ ID NO: 25355 - DNA, 735 bp, Artificial Sequence
  Description of Artificial Sequence: Synthetic coding sequence
atgcaggccgtagttcctctgaacaaaatgacagctatctcacccgagccacagaccctggcctccacggagcagaacgaagtgccgagggtggtaacttctggggaacaggaagccatactgaggggtaacgcagcagatgcggagagtttcaggcagcggttccgatggttctgctactccgaagttgctggtccaagaaaagctctgtcccagttgtgggagctctgtaaccaatggctccggccagacatacacacgaaagaacagatattagagctgctggtgttcgagcagttccttacaatcctgccgggagaaataagaatatgggttaaatcccagcatccggagagcagtgaggaagtggtcactcttatagaggatctaactcagatgcttgaggagaaagatccagtgagtcaggactctacagtgtcccaggaggagaattccaaggaggataaaatggttacagtctgccccaatactgagtcctgtgaatcgatcacactcaaggacgtggcggtcaatttcagtaggggcgagtggaaaaaattggaaccattccagaaggaactctacaaagaggtactgctggagaacttgaggaatctggagtttttggattttcccgtctcaaaactggagctgatttctcagcttaaatgggttgaacttccgtggttgctcgaagaagtttctaagtcgtcaaggttaggttctgtgatatag

SEQ ID NO: 25356 - DNA, 771 bp, Artificial Sequence
  Description of Artificial Sequence: Synthetic coding sequence
atgcaagccgtcgtccctctcaacaaaatgactgccatcagcccggagccccaaactctggcatcgacggaacagaacgaagtgccaagggtggtgaccagcggcgagcaggaggcaattctgcggggaaatgctgctgacgccgagtccttcagacaacgtttccgttggttttgctacagtgaagtggcaggaccaaggaaggctctgagccaactgtgggagctctgcaatcagtggctccggcctgacattcatactaaagagcaaatcctagagctgctggtgtttgaacagtttttgacaatcctgcccggagaaattaggatctgggtcaaatcacaacatcctgaaagctcggaggaggtggtgacactcatcgaggacctgactcagatgctggaggagaaagacccagtctcacaggacagcaccgtatcccaggaggagaactccaaagaagacaagatggtgaccgtctgtcccaataccgaatcttgcgagagtatcacactcaaggacgtggccgtgaacttctctcgcggtgagtggaaaaagctagagcctttccagaaggagctgtataaagaagtgctgttagagaacctaaggaacctggagtttctggatttcccagtaagtaaactggagctgatcagccaactgaaatgggtggaactcccatggctgctggaggaagtatccaaaagctctcggctggacattcatggggcagtgaagaagatgcagatgttttccgaagctgaatag

SEQ ID NO: 25357 - DNA, 537 bp, Artificial Sequence
  Description of Artificial Sequence: Synthetic coding sequence
atgcaggcagtggtccccctgaacaagatgaccgccatctcacccgagccacaaacactggcctcaaccgaacagaacgaagtgccacgcgttgtaacttctggcgagcaggaggccatactgcgcggaaatgcagccgatgcagagtcttttcggcagagatttcgttggttctgctatagtgaggtcgcaggccctagaaaggcgttgtctcagctgtgggagctgtgcaatcagtggctgagaccagacattcacaccaaagaacagatcctcgagctgttggtgttcgagcagtttcttaccatattgccgggagaaataaggatttgggttaaatctcagcaccctgagtcctccgaggaagtcgtgacacttattgaggatctgacacagatgttagaggagaagggggaaatctaccgatggcgcgaggaggccggagacatcgcaagtaagagcgaaagcaagttcttaaaacgcagacaattcacagcaaaggaggaatccgaagtacggtcctgggattgggtctag

SEQ ID NO: 25358 - DNA, 2451 bp, Artificial Sequence
  Description of Artificial Sequence: Synthetic coding sequence
atgctcgagaactacttcaatcttattagcgtcggctgccaggttccaaagcctgaagtgatcttctccttggaacaagaggagccatgtatgctggatggcgaaatcccctctcagtctagaccggacggcgacatcggcttcgggcctttgcaacagaggatgagcgaagaagtgagtttccagtccgagatcaacattaatttattcacccgggacgatccctacagcattctcgaggagctatggaaggacgacgagcatacaaggaagtgcggagaaaaccagaacaagcctctctcacgagttgtattcattaacaagaagacccttgccaatgacagtatcttcgagtacaaagacatcggagaaattgtccacgtcaacacgcacttggtttcttcacgaaaaaggcctcacaattgtaatagctgcggaaaaaacctcgagccaatcatcactttgtataatcgcaacaatgccacagaaaactctgacaagactataggtgacggagacatattcacccatctaaactcacacacagaagtgaccgcttgtgagtgcaatcaatgcggcaaacccctacatcacaaacaggccttgatccagcagcagaagatccacacccgggagtcactgtacttgttcagtgattacgtgaatgtgtttagtccgaagtcccacgcttttgcacatgagtcaatatgcgcagaggaaaaacaacatgagtgtcatgagtgtgaggccgtgttcacgcaaaagtctcagctagatggatcccagcgcgtttatgcgggaatctgcactgaatacgaaaaggacttcagcttgaagtctaatcgccagaaaacaccatacgaaggtaactattataagtgctctgactacgggagggcgttcatccagaagtccgacttatttcggtgtcagcgaatacactctggcgagaaaccatacgagtacagcgagtgtgaaaaaaacctccctcaaaactccaatctcaatattcacaagaaaatccacactggtggtaaacattttgagtgcactgagtgtggcaaagccttcaccaggaaatctacgctcagtatgcaccagaagattcacaccggagagaagccttatgtttgtacggagtgcggaaaggccttcattcgcaaaagccactttatcacgcacgaaagaattcacactggagagaagccctacgagtgctctgattgcggcaaatccttcatcaagaagtctcagttacatgtgcaccaaaggatccacactggtgaaaatccctttatatgttccgagtgcgggaaagtgtttacccacaagacaaatctgatcatccaccaaaaaatacacactggcgagcgtccttatatatgtactgtttgcggcaaggcctttactgaccgctccaatcttataaaacaccagaagatacacacaggcgaaaaaccttacaaatgttccgattgtggcaaaagcttcacgtggaagagccggcttagaattcaccagaagtgtcacaccggagagcgccattacgagtgctctgaatgcggcaaggcctttattcaaaagagtaccctttccatgcatcaacgtatccaccgaggcgaaaaaccgtatgtgtgtaccgaatgcggcaaggcatttttccataaatctcacttcataacacacgaaagaattcataccggcgagaaaccctacgagtgctcaatatgcgggaaaagttttacaaagaaatcccagttacacgtgcaccaacagatacatactggcgaaaagccataccgctgcgctgaatgtgggaaagcgttcactgaccggtccaacctgttcacacaccagaaaattcatacgggagagaaaccctacaagtgcagcgactgtggcaaggcattcacccggaagagtggactccacatccaccagcaatctcacacaggcgagaggcactacgagtgcagtgagtgcggcaaggccttcgcccgaaaatctaccctgatcatgcaccaacgaatccacacaggagaaaagccttacatctgcaatgaatgtgggaaatcgtttatccagaagtcccatcttaaccgtcacaggcggatacatactggagagaagccctacgagtgttcagattgcggaaaatcattcattaaaaagagtcagctccacgagcaccataggattcacacaggcgaaaaaccttacatttgcgctgagtgcggcaaagctttcacaattaggtctaacttgataaagcatcagaaaatacacacgaaacagaaaccttacaaatgttcagatctgggaaaagcactgaactggaagccccagctaagcatgccacaaaaaagcgataatggggaagtggaatgtagtatgccacaactttggtgcggggactcagagggggatcaaggccagctgtcgtccatctag

SEQ ID NO: 25359 - DNA, 2559 bp, Artificial Sequence
  Description of Artificial Sequence: Synthetic coding sequence
atgactaaaagcctggaaagtgtctcctttaaagacgtaaccgtcgacttctctcgcgacgagtggcagcaactggacctggctcagaagagtctatacagagaagtcatgctggagaattatttcaatctaattagcgtcggatgccaagtcccgaagcctgaggtgattttctcattggagcaagaggagccctgtatgctggacggcgagatcccaagtcagtcgcggcctgacggtgatatcggttttgggcctctgcagcagcggatgtcagaggaggtgagttttcaatccgaaataaacatcaacctatttacacgagatgacccatactcaattctcgaggagctgtggaaggatgatgagcacactcggaaatgcggggaaaaccagaataaaccgctgagccgggttgtgtttatcaataaaaagactctggccaatgactccattttcgagtataaggacatcggtgagatagtgcacgttaacactcacctcgtgtcatctaggaaacgaccacacaactgtaatagctgcggcaagaatctcgagcccataattaccctctacaatcggaacaatgctacagaaaattcggataaaaccatcggggacggagatatttttactcacctgaattcccatacagaagtgaccgcctgtgaatgtaatcaatgcggcaagcctctgcaccataagcaggcccttatccagcagcaaaagatacacacacgcgagtctctctatctttttagtgactatgtcaacgtgttctcccccaagtcacacgctttcgcacatgaatcaatctgtgcagaagagaagcagcacgagtgtcacgaatgcgaggccgtctttacccaaaaaagccaactggatggcagccagagagtctacgccggaatatgcacagagtacgaaaaagacttttcactcaagtcaaatcggcagaagacgccctacgagggtaattactataagtgttctgattacggtcgagcctttatccagaaaagcgatctgttccgttgccagcggatccattccggggagaagccgtatgaatactccgagtgcgaaaaaaatctaccgcagaacagtaacttgaacattcataaaaaaatccacacaggcggaaaacactttgagtgtactgagtgtggcaaggcttttactaggaagtctaccctgagtatgcaccagaaaatacataccggagaaaagccatacgtttgtacggagtgtggcaaagccttcattcggaaatctcacttcattacccacgaaaggattcacacaggggagaaaccttacgagtgtagtgattgcggcaagtcttttattaagaagtcacagctgcacgtgcatcagcgaattcatacgggcgagaatccgttcatctgctctgaatgtggaaaagtgtttacacacaagacaaatctgattattcaccagaagattcacacaggtgaaaggccctacatctgcaccgtctgcgggaaggcttttaccgatcgcagcaacctgatcaagcaccagaagattcataccggtgagaaaccctataagtgctctgactgcggaaagtcctttacatggaagagtaggttgcgtattcatcaaaaatgtcataccggagagcgccactatgagtgtagtgagtgcgggaaggctttcattcagaagtcaacattgtctatgcatcagcggattcaccgcggtgaaaagccctacgtgtgcactgaatgtggtaaagccttctttcataagagtcactttattacccatgaacgaatacataccggggagaagccctacgaatgctctatctgtggcaaaagcttcaccaaaaaaagccagctgcatgtgcatcagcagatacacaccggcgaaaaaccttaccggtgtgctgagtgcggcaaggcattcacggatcggagtaatcttttcacgcatcagaaaatccacacaggcgagaagccctataaatgttccgattgtggcaaggcctttaccaggaaatctggcttacatatccaccagcagtctcacaccggagagcggcattacgaatgtagcgaatgtgggaaggccttcgcccgtaaatcaacactcattatgcaccagcggatccataccggcgaaaagccatacatatgcaacgagtgtggaaaatctttcatccagaagtctcatcttaacaggcaccggaggatacacactggagaaaagccatatgaatgttcagactgcgggaaatctttcattaaaaagtcacaacttcacgaacatcataggattcacacaggagagaaaccatatatttgtgccgaatgcggcaaagcctttacaatcaggtcaaatctgatcaaacatcagaagatacacacgaaacagaaaccatataaatgctcagacctaggcaaagctctgaattggaaaccccaactgagcatgcctcaaaagtctgacaatggcgaagtggaatgctcaatgcctcaactatggtgcggggattcagaaggggaccaaggacagctgtcctctatctag

SEQ ID NO: 25360 - DNA, 2451 bp, Artificial Sequence
  Description of Artificial Sequence: Synthetic coding sequence
atgctggaaaattacttcaatctgatctcagtgggatgtcaagtgccaaagcccgaggtgattttctcacttgagcaagaggagccatgtatgcttgatggagaaattcctagtcaatctcggccagatggcgatattgggtttgggcctcttcagcagagaatgtctgaggaggtctccttccagagcgaaatcaacattaatctgtttacacgagatgatccctattctatcctggaggagctatggaaagacgatgagcacacgcgtaaatgtggagaaaaccagaacaaacctctttctagggtcgttttcattaataagaaaacattggctaacgactccatcttcgaatataaggatataggtgagatcgtgcatgtgaatacccacctggtttcatcgcgcaagcgaccccataactgtaattcctgcggtaaaaaccttgagccaataattaccctgtataaccgtaacaacgctactgaaaactccgacaagacaatcggcgacggagacatcttcacccatctgaatagccatacagaagttaccgcttgcgagtgtaatcagtgtggaaaaccacttcatcataagcaggctctgatccaacaacagaaaatccacacgagagaaagcctttatctgttttccgattacgtcaatgtctttagccctaaaagccacgccttcgcccacgagagtatttgcgccgaagagaaacagcacgaatgtcatgagtgtgaagccgtcttcacacagaagagccagctggacggctcacagcgagtgtatgccggaatatgcaccgagtatgagaaggacttttctttgaagtccaatcggcaaaaaacgccctacgaaggtaattactacaaatgcagcgattacggacgcgcttttattcagaaaagcgacttgttcaggtgtcagcgaattcatagtggtgagaagccgtatgagtattccgaatgcgagaagaatctcccacaaaattcaaatctcaatattcacaagaaaatccacacagggggtaagcacttcgagtgcactgaatgtggcaaagcattcacacgaaagagtacactctctatgcatcaaaaaatacacaccggggagaagccttacgtgtgtactgagtgcggtaaggcctttatcaggaaatcgcacttcattacgcatgagcgcatccatactggcgaaaagccctacgagtgcagcgattgcgggaaatcctttatcaaaaagtctcaactgcacgtacaccagcggattcacaccggggaaaatccctttatctgcagtgagtgcggaaaggtatttactcacaagactaacctcattatccaccaaaagattcacacaggagaacgaccttatatctgtactgtgtgcggcaaagccttcactgataggtcaaatctaattaaacatcagaagatccatacgggggaaaagccctataagtgcagcgactgcgggaagtcattcacttggaagagtcggctgaggatacaccagaagtgccacacaggcgagcgccactacgagtgctcagagtgcggtaaggcttttatccaaaagagcaccctctccatgcatcaaaggattcaccgcggtgagaagccttacgtgtgtactgagtgtgggaaggcttttttccataaatcccactttataacccatgagcgtattcataccggtgaaaagccctacgaatgcagcatctgcggaaagagtttcaccaagaagtctcagctgcacgtgcaccagcagatccataccggggagaaaccttatcgctgtgccgagtgtggaaaagcctttaccgatcgctcaaacctgtttactcaccaaaagatccacacaggagaaaagccctataagtgctctgactgtggcaaggcctttacccggaaatccgggctccacattcaccagcagagccatacaggggagcgacattacgagtgttcagagtgcgggaaggcttttgctcggaagtcaactctgattatgcatcagaggattcacactggtgaaaaaccttacatctgtaacgagtgtggaaaaagcttcatccagaaaagccatctgaacagacatcggaggatacacacaggagagaagccttatgaatgtagcgactgtggcaaaagcttcattaagaagtctcagttacacgaacatcacaggattcacacgggtgaaaagccgtatatctgcgccgagtgtggaaaagccttcactattcggagtaatctgattaagcaccagaagatccatactaaacaaaagccatataaatgctctgacctcggcaaagcccttaattggaaaccccaactgtctatgcctcagaagtcagataatggtgaggtggaatgcagcatgccacagttatggtgtggtgattccgagggagaccagggacagctgtcttcaatttag

SEQ ID NO: 25361 - DNA, 2565 bp, Artificial Sequence
  Description of Artificial Sequence: Synthetic coding sequence
atgtcagttctcagcctccctgagagcgtatctttcaaggacgtaaccgtggatttctctagggacgaatggcagcagcttgatctggcgcaaaagagcctttatagagaggtcatgcttgaaaactattttaacctgatctctgtggggtgccaggtccccaaacctgaggtgattttttccttagagcaagaggagccctgtatgctggacggcgagattccctcacaatcgcggccagacggggacatcggattcgggcctctgcaacagcggatgtctgaagaagtctcttttcagagtgaaattaacattaacctcttcacacgagacgacccctattctatcctggaggagctgtggaaggatgacgagcatacaagaaagtgtggagagaaccaaaacaagcccctgtcacgggttgtgtttatcaataaaaaaacattggccaacgactctatttttgaatacaaggacatcggtgaaatcgtacatgttaacacacacctggttagcagcagaaaaagacctcacaactgtaattcatgtggcaagaacctcgaacccatcatcacactttacaatagaaacaacgccactgaaaattccgacaagaccattggcgatggcgacatcttcacccatctgaattcacataccgaagtgactgcttgtgagtgcaaccagtgtggaaagcccctgcatcataagcaagccctgatccagcagcagaagattcataccagagagtctctgtacctctttagcgactacgttaatgtcttttctccaaaatcacacgcattcgctcatgaatcaatatgcgccgaggagaaacaacacgagtgtcacgagtgtgaggctgttttcacccaaaagtcgcaactagacggctctcagcgagtgtacgccggtatctgcactgaatatgagaaggatttctcactgaaatctaatcgccagaaaactccgtatgaaggcaattattataaatgcagcgattacggtagagcctttattcagaagagcgacttgttccgctgccagcggattcattccggagaaaagccttatgaatattccgaatgcgaaaaaaatctgccccagaacagtaatctgaacatccacaagaaaatccatacaggcggaaagcattttgagtgcaccgaatgtgggaaggcttttacccgcaaatctaccttgtcaatgcatcagaagatccacactggagagaagccgtatgtgtgcacggagtgcggcaaagccttcattcgcaaatcccacttcattacccacgaacgaatacacaccggggagaagccatatgagtgtagcgactgtggcaagtctttcatcaaaaagagccagctccatgtgcatcaacgaattcacacaggagagaacccttttatctgttcggagtgcggaaaggtgttcactcacaagaccaacctcatcattcaccagaagatccacaccggagagaggccatatatttgcaccgtgtgcggtaaagcctttactgacaggtctaacttgataaagcaccaaaaaattcataccggagaaaaaccctacaagtgtagtgactgtggcaaaagtttcacctggaagtctagactgcgcatccatcagaagtgtcacacaggcgaaaggcattatgagtgtagcgagtgcggaaaagccttcatccagaagagcacactaagtatgcaccagaggatccaccgcggagaaaagccttacgtgtgcaccgaatgtgggaaggcctttttccataaaagtcatttcattacccacgaacggatccacacaggcgaaaagccatacgaatgttctatatgtggtaagagctttaccaagaaaagtcagcttcatgttcaccaacagattcatacgggtgagaaaccatataggtgtgcagaatgtgggaaagcctttactgatcgatcgaatctattcacccaccagaagattcacaccggcgaaaaaccatataagtgctctgattgtggaaaagcattcacaagaaaatccggcctgcacattcaccagcaaagccatacaggggagagacactatgaatgttcagaatgcggcaaggcctttgccagaaagtcaaccctcataatgcaccagcgaattcacaccggcgagaagccgtacatctgcaacgagtgcggaaagagttttatccagaagagccacctaaataggcatcggcgaatacataccggcgaaaaaccctatgaatgttccgattgcggaaaatcatttatcaaaaaatcccagctccacgagcatcaccggatccacacaggtgagaaaccttacatctgcgcagagtgcggaaaggcgttcaccattagatcaaatttgataaagcatcaaaaaatccacacaaagcagaaaccctacaagtgctcagatttgggcaaggctcttaactggaagccccagctgagcatgccacaaaagtctgataacggtgaggtggagtgcagcatgccgcagctgtggtgcggcgactcagagggcgatcaagggcaactatctagtatatag

SEQ ID NO: 25362 - DNA, 1326 bp, Artificial Sequence
  Description of Artificial Sequence: Synthetic coding sequence
atggcacccagggcacagatccagggccctttgacattcggcgacgtggccgtagcgttcactcggattgagtggagacacctggacgccgctcagcgcgctctttacagggatgtcatgctcgaaaactacggaaacctggtgagtgtgggtctgctatcatctaaacccaagctgattactcagttggagcagggtgcagagccctggactgaggtcagagaggccccttccggtacccacgccgtagaagactattggtttgagacgaagatgtcagctctgaaacagtctacctccgaggcctcagtgcttggcgagagaacgaagtcagtaatgatggagaagggtctggactgggaaggtcggagttcgactgaaaagaactacaaatgcaaggaatgtgggaaggtcttcaagtataattcaagcttcatctcacatcaacggaatcacacatctgagaagcctcacaagtgcaaagagtgcggcattgccttcatgaatagcagttccctgctgaaccaccataaggtacatgccggtaagcaaccatacagatgtattgaatgcgggaagttcttgaagaagcatagcacctttattaaccaccagagaatacactctagggagaagccccacaagtgcattgaatgtggtaagacctttaggaagaatagtatcttgttgagccaccagcggatccacactggtcaaaagccctacaagtgcaacgactgtggaaaagcctttgctcaaaatgcagccctcacccggcacgagcgtatccactcaggggaaaaaccattcaaatgcaacaagtgcggacgggcttttagagataacagcacggttttggagcaccagaaaattcacacgggggaaaaaccctatcagtgtaacgagtgcggaaaagcctttcggaaatcctccaccttgattagtcaccagcgcatgcacactggtgagaagccataccactgtagcaaatgcggcaaatcctttaggtattcgtctagcttcgctgggcaccagaagacccacagtggcaacaagccttatcagtgtagagattgcggcaaggcgttcactaaatctagtaccctcacgggtcatcagagaatacataccggcgagaagccgtatcactgcaagaaatgcggtaaggcctttagacacagtagcggtctggtcgaacaccagcgactccacactggcgagaaaccctacaagtgcaatgagtgcggcaaagcctttcctaggtcgtcagccctgaaacagcataagaagatccataataaggaaagggctatgaagtgctcatag

SEQ ID NO: 25363 - DNA, 1326 bp, Artificial Sequence
  Description of Artificial Sequence: Synthetic coding sequence
atggcccctcgggcacagatacagggcccactcacatttggtgacgtggctgtggcgtttactaggattgagtggagacatcttgatgctgcccagcgggcactgtaccgagatgtcatgctggaaaactacggaaacctggtcagtgtgggtctgctcagctccaaaccgaagctgatcactcagcttgagcagggagcggaaccttggaccgaagtgagggaggcacccagcggaacccacgcagtggaggattactggttcgagaccaaaatgagcgctctcaaacaatcaacctcagaggcgagtgtgttgggcgagagaacgaaaagcgtcatgatggagaaaggactagactgggagggcagaagctccacagagaagaattataaatgtaaggaatgcggaaaggtattcaaatataattcgagttttatctcacatcaacggaatcacaccagcgagaaacctcacaaatgcaaagagtgcggaattgctttcatgaactcctcgtccctgcttaaccaccataaagtgcatgcagggaaacaaccttatcggtgcattgaatgcggaaagtttttaaaaaaacattcgaccttcatcaaccaccagcgcatacactccagagaaaaaccccacaaatgtatcgagtgtggaaaaaccttccgaaaaaactcaatcctgctcagtcatcaaaggattcatactggccaaaagccatacaagtgtaacgactgtggtaaagccttcgctcagaatgcagcactcacgcgccacgagcgcatccactccggggagaagccatttaagtgtaataaatgtggcagggcattccgggacaactcgactgtgttggaacaccagaagatccacacaggtgagaagccttatcagtgcaatgagtgtggtaaagcctttagaaaatcctccacacttatatctcaccagagaatgcacaccggtgagaaaccgtatcattgtagcaagtgcggcaagtcatttaggtatagcagctccttcgctggacatcagaaaactcacagcggtaataagccctaccagtgtcgcgattgcggcaaggcatttaccaagtctagcacacttacaggccatcagcgcatccacacaggcgaaaaaccctatcactgtaaaaagtgtggcaaagccttccgccacagctctggactcgtggagcaccagagactgcatacaggagaaaagccttacaagtgcaacgaatgcggcaaggcttttcctcgctcatccgctctgaaacagcataagaagatccacaataaggaacgcgctatgaagtgttcttag

SEQ ID NO: 25364 - DNA, 1053 bp, Artificial Sequence
  Description of Artificial Sequence: Synthetic coding sequence
atgtcagccctcaagcagagtacctcggaggcatcagtgcttggggaacgcaccaaaagcgtcatgatggagaagggtctggattgggaagggaggagctctacggaaaagaactataagtgcaaggagtgtggcaaagtgttcaaatacaactctagctttattagtcatcagcgcaaccataccagtgaaaagccccacaagtgtaaagaatgtggaattgcctttatgaattccagctccctgctgaaccatcataaggtccacgcgggaaaacagccttatagatgcatcgaatgcgggaagtttttgaagaagcactccaccttcatcaatcaccagcggatccacagccgcgaaaaacctcacaagtgtattgagtgcggaaagacattcagaaaaaactctatcctgttgtctcaccagcgcattcacaccggtcagaagccatacaagtgcaatgattgtgggaaagcctttgcacaaaatgccgctcttaccaggcatgagcgcatacattctggggaaaagccttttaagtgcaataagtgcggcagggcattccgggataattccacagtgctggaacatcagaaaatccacaccggagagaagccctaccaatgcaacgagtgcggaaaggcttttaggaagtcctcgacactgatttcccatcagagaatgcacaccggcgaaaagccttaccactgctctaagtgtggcaagtcctttcgttatagctcatcattcgctgggcaccagaagactcactcaggcaacaaaccataccagtgtagggactgcggcaaagctttcaccaagtcctccaccctgaccggccaccagagaatccatactggcgaaaaaccctatcattgtaagaaatgcggcaaagccttcaggcacagctctggacttgtcgagcaccagcggctacacaccggtgagaaaccctacaagtgtaacgagtgcgggaaggcttttccccgatcgagtgcactgaagcaacacaagaaaatacacaataaggaaagggcaatgaaatgctcttag

SEQ ID NO: 25365 - DNA, 354 bp, Artificial Sequence
  Description of Artificial Sequence: Synthetic coding sequence
atggccccacgtgcccagatccaaggaccattaacctttggtgacgttgctgtggcttttactcggatcgaatggagacacctggatgccgctcagagagcactataccgcgatgtaatgttggagaactacggtaacctcgtgtccgtgggactattaagttccaaacccaaattaatcacccaacttgagcagggagccgaaccatggacggaagtgagagaagccccatctggcacgcatgcggtcgaggattactggtttgagacgaaaatgtccgctctgaagcagtcgacctcggaggcaagtgtgctgggcgaaagaactaaatccgtaatgatggaaaagggatag

SEQ ID NO: 25366 - DNA, 1392 bp, Artificial Sequence
  Description of Artificial Sequence: Synthetic coding sequence
atgcctggcccacttagatctctggagatggagagtttgcagttcagagatgtcgccgtagaattttcactcgaggaatggcattgcttggacactgcccaacaaaatctctacagggacgtcatgctcgaaaattacaggcatttagtttttttaggcattatcgtttctaagccggatctgatcacctgtctggaacagggcatcaagccactgactatgaagcgccatgaaatgatagctaaaccaccggtcgtctgctctcatttcgcccaggacttgtggcctgaacagtctatcaaggactcgtaccagaaagtcattttgcggaagtttgagaaatgtggccatgggaatctgcactttaagaaaggatgtgagagtgtggacgaatgtaaactgcataaacgcggttataacggcctcaatcaatgcttgaccaccacacagtcgaaaattttccagtgtggaaagtatgtgaaggtttttcatcaattctccaattctaagcgccacaagagaagacacactgagaaaaagcccctcaaatatatcgagggggataaagcctttaatcagtcaagtacccacacgactcacaaaaagattgacactggagaaaaaccctataagtgtgaggagtgcggaaaagcattcaatcgttcgtcccatcttaccacacacaaaataactcacacacgggagaaaccctataaatgtgaggagtgcggtaaagtgtttaaatacttctcttcatttaccacacacaagaaaatccacagtggcgaaaaaccctatatctgcgaggaatgtggtaaggcttttatgtatccctatacactcaccactcataaaatcattcacacgggcgagcagccctacaagtgcaaggagtgtgataaggccttcaaccatccagcaacacttagtagccataaaaagatccatacaggagaaaaaccttatacatgtgataaatgtggaaaagctttcatcagctccagcattttgagtaagcatgagaagatccacaccggggagaaaccctataaatgtgaagaatgcggcaaagcttttacacgatcctctcaccttaccatgcataagatcatacacacaggagaaaaaccttacaagtgtgaggaatgtggtaaagcttttacgtggtctgctggactgcataaacaccgaagaacacataccggggaaaagccttacaaatgtgaagagtgcggcaaagcttacaccacatcgtcaaacctgaccgagcacaaaactactcataccggtgaaaaaccttacaaatgtaaagagtgcggtaaggcatttaattggagtagcgacctgaacaaacacaaaaggatacacataggtcaaaagccccgaacctag

SEQ ID NO: 25367 - DNA, 1509 bp, Artificial Sequence
  Description of Artificial Sequence: Synthetic coding sequence
gtttctaggtgtatatggtcctcccggtcgccactcaggtactccgtcagcagcgcccctagaggacctccctccgttgcactgtgccccgtgggtatcggaagaagtaccgctaaaatgcccggtccacttcgttcattggaaatggaatctctgcagtttagagacgtggcagtcgaattttcactggaagagtggcattgcctcgataccgctcaacagaacctgtaccgggatgtgatgttggaaaattatcgccatttagtattccttggtatcatcgtcagtaaacctgatttaataacctgtctagagcagggaatcaagccgctgacaatgaaacgacatgagatgatcgccaaaccacccgtggtgtgctcacatttcgctcaggatctctggcctgaacagtcaatcaaagattcttaccagaaggttattttgcggaagttcgagaagtgtggacacgggaatttgcattttaagaagggatgtgagagcgtggacgagtgcaaactgcacaaaagggggtacaatgggctcaaccagtgcttaactacaacgcagtcaaaaatctttcagtgtggaaagtatgttaaggtgtttcatcagttcagtaactcaaagcggcataaacgcaggcacacagagaaaaaacccctgaaatacatagaaggggataaggcttttaaccagtcttctacccacactacacataaaaagattgacaccggcgagaagccttacaaatgcgaagagtgcggcaaggctttcaatcggagcagccatctcacaacacacaaaatcactcacactagggaaaaaccatataagtgtgaggagtgcggcaaagtctttaagtatttcagcagctttactactcacaaaaagatccatagcggtgaaaagccatatatctgcgaagagtgcgggaaagcctttatgtatccatatacacttactactcataagataattcacaccggcgagcaaccttataaatgtaaagagtgcgacaaagccttcaatcatccggcaacgctaagcagccacaaaaagattcatacgggtgagaagccatacacttgtgataagtgtggtaaggcattcatttcctctagcattcttagcaaacacgagaaaatccataccggcgagaaaccctacaagtgtgaagagtgcggaaaggccttcacacgctcctcccacctgaccatgcataaaattattcacacgggggaaaagccctacaaatgtgaggagtgtggcaaggctttcacttggagcgccggtctccacaaacatcgtcgaactcacacaggtgagaagccctacaaatgcgaggaatgtggaaaagcctacactaccagctcaaacctcactgaacataagacgacccataccggtgagaaaccttacaagtgtaaggagtgtggcaaagcgttcaactggtcctcagacctgaacaagcacaagagaatccatattggacagaaacctcgaacctag

SEQ ID NO: 25368 - DNA, 573 bp, Artificial Sequence
  Description of Artificial Sequence: Synthetic coding sequence
taacgccctcgtccacggacgccttctcggggaccatctgacttgcggttcaggggcgaggccggactgaggcgcgtctttttaaagaaggctggcggtagcgtgtccttcagcgacgtggctgtcggcttcacacaggaagagtggcagcacctggactctgctcagagaacgccatatagggatatgatgttggaaaactattctctgttgctgagcgttggctactgtattaccaaacccgaagtggtgtgcaagctcgagcacgggcaggtcctgtggatcctcgaggaagagtccccctcgcaaagccacctggactgttgcatagacgacgacctcatggagaagaggcaggaaaaccaagatcagcacttacaaaaagtggacttcgtgaacaacaaaaccctcaccatggatcgaaacggagttcttggcaagaccttctccctggacactaacccgatcctgagtaggaagatccggggaaactgcgacagcagtggaatgaatcttaacaacatttctgaactgatcatcagcaaccgttcctcctttgtgcggaacccttag

SEQ ID NO: 25369 - DNA, 1347 bp, Artificial Sequence
  Description of Artificial Sequence: Synthetic coding sequence
atggcctcccgccctcgtcctaggacaccaagccggggtccatccgacctgagatttagaggggaagcaggattacgcagagttttcctgaagaaggccggagggtccgtatcattctccgatgtggccgtcggtttcacccaggaagaatggcagcacttggattccgcacagcgcactccctacagagatatgatgctagagaattatagtcttcttcttagtgtgggatattgcattacaaagcctgaggtggtgtgtaagttagaacatggacaggtactgtggattctggaggaggagagcccctcacagtctcaccttgactgctgcatcgacgatgatctcatggaaaagcgccaggaaaatcaagatcagcatctgcagaaagtggattttgtaaacaataaaacactcactatggaccggaatggagtcttagggaaaactttctctctggacacaaatcccatcctgagtcgtaaaattcggggtaactgcgattcttccggtatgaatctcaataacattagtgagctcattatctcaaacagatcctcctttgttcggaatccggcagaatgcaatgtgagaggaaagtttttattgtgcatgaaacgtgaaaatccctacgctagaggcaagcccctagagtatgatggcaatggcaaggcagtgagccagaatgaagatctgtttaggcaccaatacatccagacacttaagcagtgtttcgagtataatcacagaggctatacggaagaaaggaatcctatgaatgccctcaacgtgggcaaactgttagatataggacatgccttgcagtacattaaggagcacacgcgggacaagacctatgaatgtaacgagtgcggcaagaacttttgtgaaaaatccaatctgcacgtccaccagcgcacacacacaggcgagaagccttatggctgcaatgagtgccagaaagccttcggtgataggtctgcactgaaagtccatcaaagaattcacacaggtgagaaaccatatgaactgcaccagagaacacacactggcgagaagccttacgcctgctccgagtgcggtaagaccttctaccaaaagagttcgctgaccacccaccagcgcactcatactagggagcaaccgtatgagtacaacgagtcattttatcagaatcctaattttacaaagtgtcagagggacaatattgaggaaaccttggtgaatattcttaaagcccagaagcccagtccttcctggacaaggtcaatcgccgagacgacacaagtcggcggatcagtgtccctaaaggacgtaaccgttgactttacacaggaagagtggtag

SEQ ID NO: 25370 - DNA, 627 bp, Artificial Sequence
  Description of Artificial Sequence: Synthetic coding sequence
atgatgctggaaaattactctctcttactgtccgtgggttattgcatcaccaaacccgaggttgtttgcaaactcgaacacggccaggttctgtggattctggaggaagaatctccatcgcagtcacacctagactgctgtatcgacgatgatctgatggagaagcgacaggagaaccaagaccagcacctccagaaggtggattttgtcaataataaaactcttactatggatagaaatggagtcttagggaaaaccttcagtcttgacaccaatcctatcctgagcagaaagatcagaggtaactgtgactcaagcggtatgaacttgaacaacatcagcgaattgatcatttctaatagatcttcctttgttaggaaccctgctgagtgcaatgttagagggaagttcctcctgtgtatgaaacgagagaacccttacgcaagaggaaaacctctcgaatacgatggtaacggaaaagccgtgagtcagaacgaggatctgttccgtcaccagtacatccagacgctcaagcaatgcttcgagtacaatcagtgtggtaaggctttccacgaggaagctgcctgctctactcataagagagtttgctcgtgggagaccctgtag

SEQ ID NO: 25371 - DNA, 420 bp, Artificial Sequence
  Description of Artificial Sequence: Synthetic coding sequence
atgatgctagagaactacagcttgctgctctcagtggggtactgtattaccaaacccgaggtggtgtgcaagctggaacacggtcaggtgctctggattttggaggaagagtccccgtcacagtcccacctggactgctgtatcgatgatgatttgatggagaaaaggcaggagaatcaggaccagcacttgcagaaggtcgacttcgtgaataataaaaccttaactatggacaggaacggggtgctggggaaaacattttccttggatactaatccaatacttagtaggaagatcagaggcaattgtgattcatccggtatgaacctgaacaatatttccgaactgataataagcaatcgctcctccttcgtgcgcaacccagctgaatgcaatgtcaggggaaaattcctgttgtag

SEQ ID NO: 25372 - DNA, 360 bp, Artificial Sequence
  Description of Artificial Sequence: Synthetic coding sequence
atgatgctagaaaactacagccttctcctgagcgttggttattgtattacgaagccagaagtcgtctgtaaactggaacatggacaggttctgtggatcctggaggaagagtcgccatctcagtctcacttagattgttgtatcgatgatgacctcatggaaaagcgccaggaaaatcaagaccagcacctgcaaaaagtagatttcgtgaacaacaagactttaacgatggaccgcaatggcgtgctgggaaagactttttctctggacacaaatcccatcctttcacgaaagatccggggtaattgtgacagtagcggcatgaacctgaataacatatccgaacttataatcagttag

SEQ ID NO: 25373 - DNA, 1023 bp, Artificial Sequence
  Description of Artificial Sequence: Synthetic coding sequence
atgccagagtggcccccatgtttgtcagtggcccctgcgctcgtaatcacaatggcagcaggcaagggtgcaccactgtcaccttccgcggagaatcgttggcgactttctgagcctgagctcggcagaggttgcaagcccgtgctgctcgagaagacgaatcggctcggacctgaggctgccgtcggacgggcaggtagggatgtgggaagcgcagaacttgccctactagtcgcccctggaaagcctcgcccaggaaagccactcccccctaagacccgcggagagcaaaggcaatccgcctttaccgaacttcctaggatgaaagaccgccaagtggatgcccaggcccaagaaagggagcatgacgaccccacgggccaaccgggtgcccctcagctcactcagaacatcccgagaggacccgcagggagtaaggtcttttctgtgtggcccagcggagcacggagcgagcagcgatctgccttttccaaacccactaagcggccagcagagcggccagaattaacaagtgtctttcctgctggtgagtctgctgatgccttaggagaactcagtggactgttaaacaccaccgacctggcctgctgggggagactgtctacacccaaactcctggttggagatctttggaacctgcaggctctccctcaaaatgcaccactgtgcagcactttcttgggagcccctacactgtggctagagcacacccaggctcaggtcccccctccctcttccagcagcaccactagttgggctcttctgcctcccacgctaaccagccttggtctgtccactcaaaattggtgcgcaaaatgcaacctctcttttagactaacctctgacttagtcttccatatgcgttctcatcataagaaggagcacgccggaccagacccacattcccagaagcgccgtgaggaagcactggcatgtcctgtttgccaagagcacttccgggaacgccatcaccttagtagacatatgacctctcattcttag

SEQ ID NO: 25374 - DNA, 222 bp, Artificial Sequence
  Description of Artificial Sequence: Synthetic coding sequence
atgcctgaatggccaccctgtctgtccgtggccccagcactagtaattacaatggctgcaggcaagggggctcctctcagccccagtgctgagaaccggtggcggctgagcgagcccgagctgggaaggggctgcaagcccgtgctgctcgaaaagacaaatcgactggggcctgaggcggcagtcggcagagctgggagggatgtcggctctgccgagtag

SEQ ID NO: 25375 - DNA, 360 bp, Artificial Sequence
  Description of Artificial Sequence: Synthetic coding sequence
atgcccgagtggcccccttgtctctccgtggccccagccttagtcatcaccatggctgcaggtaagggagcacctcttagtccatccgccgagaatagatggcgccttagtgaaccagagcttggccgaggatgtaagcccgttttgctggagaagaccaacagactaggtcccgaagctgccgtaggaagggcagggagagatgtgggttcagctgaacttgctctcctggtggcccctggtaaaccccgtcctggcaagcctctgccacccaagacacggggagaacagcggcagagcgcatttactgagcttcctagaatgaaggatcgccaagtggacgctcaggctcaggaatag

SEQ ID NO: 25376 - DNA, 318 bp, Artificial Sequence
  Description of Artificial Sequence: Synthetic coding sequence
atgcccgagtggccgccatgtctgagcgtcgcacccgcattggtgataactatggccgctggtaaaggggcaccattgtccccatccgcggaaaacagatggaggctcagcgagccagaactggggagggggtgcaaaccggttctgctggaaaaaaccaatcggttgggacctgaagcagccgtgggcagagccggacgcgatgtcggatcagccgagttggctttgctggtcgcaccagggaagccgagaccaggaaaaccacttcctcctaagacacgtggggagcagagacaaagcgccttcaccgaactctag

SEQ ID NO: 25377 - DNA, 261 bp, Artificial Sequence
  Description of Artificial Sequence: Synthetic coding sequence
atgccagaatggcccccttgcctgagcgttgcccctgcactggtgattacgatggccgcaggcaagggggctccactgtcacccagcgccgagaaccgctggcgcctgagtgaacccgaattggggcgaggctgcaaaccagtccttctcgagaagacaaacagactggggccagaagcggctgttggtcgtgcgggaagagacgtgggcagcgctgagctcgcactgctagttgctcccggaaagcccaggccgggatag

SEQ ID NO: 25378 - DNA, 210 bp, Artificial Sequence
  Description of Artificial Sequence: Synthetic coding sequence
atgccagagtggcccccttgcctctcagtggcaccagctctcgtgattaccatggccgctggaaagggggctcccctctctccctcagctgagaatcggtggcgactgtcagagcccgagctggggaggggatgcaaaccggtactcttagagaaaacaaaccgattggggcctgaagctgcagttggtcgcgcagggcgagacgtctag

SEQ ID NO: 25379 - DNA, 393 bp, Artificial Sequence
  Description of Artificial Sequence: Synthetic coding sequence
atgcctgaatggccaccctgtctctccgttgctccagcactagtgattacaatggccgctggaaagggtgcaccactctccccctccgcagagaaccggtggcgactctccgaaccagaattaggcaggggctgtaagccagtgctattagagaaaacaaataggctgggcccagaagccgctgtggggagagccggtagagacgtcgggagcgccgagctggctctcctagtcgctccaggaaagccaagaccagggaagcccttgccccctaaaaccaggggcgagcagaggcagtccgcctttacagagcttcctcggatgaaggaccgccaggttgatgcccaggctcaggagagagagcatgacgaccccaccggacagcccggatag

SEQ ID NO: 25380 - DNA, 1590 bp, Artificial Sequence
  Description of Artificial Sequence: Synthetic coding sequence
atgcggaggaattcctcgctttcttttcagatggaacggcctcttgaagagcaggtgcaaagcaaatggtcctcttcacaaggaaggactggtactggcggatctgatgtgcttcaaatgcaaaattccgagcaccacggtcagtcaatcaagacacagaccgactctatcagcttggaagatgtggccgtcaattttaccctggaggagtgggcattgctggacccgggtcagcgaaatatctacagagatgttatgagggcgaccttcaagaatctcgcctgtatcggggaaaaatggaaagatcaggatattgaggacgaacacaaaaaccaagggagaaatcttagaagccctatggtggaggctctgtgtgagaacaaggaagattgcccctgcggcaagtcaacatcccagatccctgatttaaataccaacttggaaacacccacaggcctgaaaccctgcgattgtagcgtgtgtggcgaagtgttcatgcaccaggtctccttgaacaggcacatgagatcccacactgagcagaaacctaatgagtgtcacgagtacggtgagaagccccataagtgtaaagagtgtgggaagaccttcacaaggtcctcctcaattcggacccatgagcgcatccacacaggcgagaagccctatgaatgcaaggagtgtggtaaagcgtttgcctttctgttcagtttcagaaaccacatacgcatccacaccggcgagacaccgtatgagtgcaaagaatgcgggaaggcctttcgctatcttactgcactccgcagacacgagaaaaaccacaccggggaaaagccctataagtgtaagcagtgcggaaaggcatttatttattatcagccattcttgacacacgagagaacacacacaggcgaaaaaccttatgagtgtaagcaatgtggcaaggcgtttagctgtcctacctacctgcgctcccacgagaaaacccacacaggtgaaaagcctttcgtctgtagggagtgcggaagagcttttttttcacacagctctttgcgaaagcatgtgaagacccacactggagtgcaaccttacacatgcaaaaagtgtggggaggctttcaaatcgtcttcaagttgtgaggtccacgagcgcactcatttcggggagaagccttacgaatgcaaacagtgtggcaaggcattcaatagctcaagctatctccagctgcatgaacgggtgcacactggagagaaaacctacgagtgtaaggaatgtgggaaggcttttctctattcaacacattttcggatccacgagagaacccatacacgcgagaaaccgtacgaatgtaaacagtgcggcagagtgttcatttatttctcccacttgcggaggcatgaacgtagccataccggcgtaaaaccgtgtgagtgcaagcaatgcggtaaggcctttacatgccttaactcccttaaggtccacaagcgtatccacacaggcgaacgaccatttcagtgccggcagtgcggcaaagcctttagctatagcaagagtctgcacgttcatgagcgcacacacagccgacagaagccctag

SEQ ID NO: 25381 - DNA, 1314 bp, Artificial Sequence
  Description of Artificial Sequence: Synthetic coding sequence
atgggcgagagactgtttgagagtgctgaggggtcacagtgcggggaaacgttcacacaagtgccagaagacatgctcaacaagaaaactctgcccggtgtaaagtcttgcgaatccggaacctgtggcgagatttttatgggatactccagctttaatcgaaacatcagaacggacactggccatcaacctcacaaatgccaaaagtttttggagaagccatacaagcataagcaacggaggaaggccctcagccattctcactgcttcagaacacacgagagaccccatacccgcgagaaacctttcgattgcaaggagtgtgagaaatctttcatctcgcctgctagcatccggagatatatggtcacccattccggcgacggaccatacaagtgcaaattttgtggaaaagcgctggactgtttaagcctctatcttacgcacgagcgcacccacacaggggagaagagatacgaatgtaaacaatgcggaaaagccttttcatggcattcctccgtgcgcattcacgaacgcacgcataccggcgagaaaccatacgagtgcaaggaatgtgggaagtccttcaattttagttcaagctttcgccgacacgagcgcactcacaccggggaaaagccttataaatgcaaagagtgcgggaaagcatttaactgcccttcaagcttccatcgccatgagcgcacacataccggggagaagccctacgagtgcaagctgtatggaaaagcgctgtcacgactcatcagtttcaggagacacatgcgaatgcatactggagagcgcccacacaaatgcaagatttgtggcaaagccttttacagccctagttcatttcagaggcacgagcgatcccatactggcgaaaaaccctacaagtgcaagcagtgcggcaaagcttttacgtgtagcacttcctttcagtatcacgagcggacgcatactggagaaaaacctgacggctgcaagcagtgtgggaaggctttccgatccgctaaatatatcagaattcatggcagaacccacacgggtgaaaagccttacgagtgtaaacagtgcggtaaggccttccattgcgtttcaagctttcatcggcacgagcgaacccatgcaggcgaaaaaccatacgagtgcaagcactgtggaaaagctttcacctgctctatctatatcaggatccatgaaagaattcacacgggtgaaaagccgtaccagtgtaaggagtgcgggaaggctttcataaggagttcttattgcagaaaacacgaaagaacacataccatcaatatctag

SEQ ID NO: 25382 - DNA, 420 bp, Artificial Sequence
  Description of Artificial Sequence: Synthetic coding sequence
atgggggagcgcctcttcgaatcagcagagggtagccagtgtggggagacattcactcaggtgccggaggacatgctcaacaagaaaactcttcctggcgtgaaatcttgcgagagcggtacttgcggggaaattttcatgggatactcatcttttaaccggaacatacgcactgacactggacatcaacctcacaagtgccagaaatttctggagaagccctataaacacaagcaaagacggaaggcactcagccattcccactgcttccgcacccacgagcgccctcatactcgtgagaaaccttttgattgcaaagaatgtgagaagtcgtttattagcccggcatctatcaggcgatatatggtgacccactctggcgatgggccttataagtgcaagttttgtggcaaagcatag

SEQ ID NO: 25383 - DNA, 1230 bp, Artificial Sequence
  Description of Artificial Sequence: Synthetic coding sequence
atgggggaacggctgtttgagagtgccgagggaagtcagtgtggggagacttttacgcaagtcccggaggatatgctcaataaaaagactttgcctggagtaaagagctgcgaaagtgggacatgcggtgagatctttatgggttactcctccttcaatagaaacattagaacagataccgggcaccagcctcacaagtgtcaaaagtttttagagaagccatacaaacataagcagcggaggaaggcgctttcacattctcactgctttagaacacatgaacggccacatacaagagagaaacctttcgattgcaaggagtgtgagaaaagtttcatcagcccggcttcaattcggaggtacatggtgacacactccggggatggaccttacaaatgcaagttttgtggcaaagccctggattgcttgtcactgtacctgacccatgagcgaactcacaccggggagaagcgttacgaatgcaagcagtgtggaaaagcattcagctggcattcaagcgtgaggatacacgagaggacccatacgggtgaaaaaccatatgagtgcaaggaatgtgggaaatccttcaacttcagcagtagctttagacgacacgaacgaacacacactggagagaaaccttatgaatgcaagctatacgggaaagctctgagcaggctgatcagcttcaggagacatatgcgaatgcacacaggggaacggcctcacaagtgcaaaatttgtggcaaagctttctacagcccttccagctttcaaaggcacgagcgatcacacacaggcgagaaaccgtacaaatgtaaacagtgcggcaaggctttcacatgtagtacctcctttcaatatcacgagagaactcatacaggtgagaaacccgatggatgcaagcagtgtgggaaagccttccgttcagccaagtatatcagaattcacggaagaacccatactggagagaagccgtacgagtgcaaacagtgtggaaaggccttccattgtgtctcttccttccatagacacgaacgtactcatgccggtgaaaagccctatgagtgtaaacattgtgggaaggcatttacttgctcgatctatatcagaatccacgaacggatacatacaggagagaagccatatcagtgtaaagagtgcggcaaggcattcattcggtcctcttactgccgtaagcacgagagaacacacaccatcaacatatag

SEQ ID NO: 25384 - DNA, 1596 bp, Artificial Sequence
  Description of Artificial Sequence: Synthetic coding sequence
atgctggagaattaccgcaatctggtgttcgttgggattgccgcttcaaaacctgacctgataacatgtttagagcagggcaaagagccatggaacgtgaagaggcatgaaatggtggctgagcccccagtagtgtgctcttacttcgcccgagacctgtggccgaagcaaggtaaaaagaattactttcaaaaagtgatactacgaagatataagaagtgcggttgcgaaaatctgcaactccgcaagtattgtaaatcaatggacgagtgcaaggtgcacaaggaatgctacaacggattaaatcaatgccttacaacaacacagaataaaattttccagtgcgacaagtacgtcaaggtgttccacaagttttccaacagcaaccggcacaccattcgccatactgggaagaagtctttcaaatgtaaggagtgtgagaagagtttctgtatgttgtcccatctggcccagcacaaacgcatccatagcggtgagaaaccatacaagtgcaaggaatgtggcaaggcatataatgagacctctaacctaagtacccataagcggatacatacgggcaaaaagccgtataaatgcgaggaatgcggtaaagccttcaatcgcttgtcccacctaactacgcacaaaattatccacacagggaagaaaccatataagtgcgaggaatgtgggaaggcttttaaccagtctgccaacttgaccacccacaagcgaattcacaccggagagaaaccctataagtgtgaggaatgtggtcgtgcatttagtcagagctcaacactgaccgcccacaagatcatccatgccggagagaaaccatacaaatgtgaagaatgcggcaaggcattctctcagagttcgactctgaccacgcacaagatcattcataccggagagaaattctataagtgcgaagagtgtggaaaggccttttcccagctgagccatctgacaacccataaacgcattcactctggcgagaaaccttacaagtgtgaggaatgcggaaaggccttcaagcagagttccaccctcaccacgcacaaaaggattcacgcaggggaaaagttttataaatgcgaagtgtgttctaaggcattctcccgcttcagtcacttaacaacccacaaaaggatacatacaggggagaaaccctataagtgcgaggagtgtggcaaggcgtttaacctgtccagccagcttacaacccacaagatcatccacaccggcgagaagccatacaaatgtgaagaatgcgggaaagccttcaaccagagcagtactctgtcgaagcacaaggtcattcacaccggcgagaaaccatacaagtacgaggaatgtggaaaagcctttaaccagagctctcaccttaccactcacaaaatgattcataccggcgaaaagccctataagtgcgaggaatgcggaaaggccttcaataattcttcaatcctgaataggcataagatgattcacacgggtgagaaactgtacaagccagagagctgcaacaacgcgtgtgacaacattgccaaaatttcaaaatataagcggaactgcgccggtgaaaaatag

SEQ ID NO: 25385 - DNA, 1941 bp, Artificial Sequence
  Description of Artificial Sequence: Synthetic coding sequence
atgaacgagtgtaatgtccacaaagagggctataacgagctcaatcagtacctgactaccacacagagtaagattttccagtgcgataagtacgtcaaggtattccacaagcttctgaattcgaatcggcacaacacgaagcataccggtaagaagcctttcaaatgcaagaaatgtggtaagagcttctgcatgctccttcatctgtgccaacataaaagaatacacattcgcgaaaactcttataggtgtgaggagtgcgggaaggccttcatctggttcagtacactaacacgtcatcggagggttcacaccggtgaaaagtcatataagtacgagtgcggcaagtcatttaaccaggactccaatctcacaacccacaagcggatccacacaggtcagaaaccatacaagtgcgaagaatgtggtacttctttctaccagttctcatatttgactcggcataagttgatccacactagagaaaagccctacaagtgcgagcaatatggtaagaccttcaaccagagcagtacactcaccgggcataaaatcatccacaacggggaaaaaccctacaaatgcgaggagtgcgggaaggctttcagtatttttagtactcctaccaagcataagattatccacacagaggagaaaagccaccggtgcgaggagtattgcaaggcttacaaagagagtagtcacttgacgactcataagcgtattcataccggggaaaagccgtacaaatgtgaagagtgcggcaaagccttttcaatcttctctaccctgactaaacataaaatcattcataccgaggagaagtcacatcgatgtgaggagtgtggcaaagcctacaaggaaagtagccatctgacaactcacaaaagaatccataccggcgaaaagccatacaaatgtgaagagtgtgggaagacattttcagtgttttctatccttacaaaacataaaatcatacatacagaggaaaagccttataaatgcgaggagtgcggaaaagcttttaagagatcctccaccctgactaagcaccgaattattcacactgaagagaagccctacaagtgcgaggaatgtggaaaagcattcaaccagtcaagcactctttccatccacaagattatccatacaggtgagaagccgtataagtgtgaagaatgcgggaaggcttttaagcggagctctacgctcacgatacacaagatgattcatacaggtgaaaagccgtacaagtgcgaggagtgcgggaaagctttcaaccgctcatctcacctaacgacgcacaagcgaatccatacaggccataaaccctacaagtgcaaagagtgcggcaaatcttttagcgtctttagcacactcaccaagcacaagatcattcataccgacaaaaaaccttacaagtgtgaggagtgcggcaaggcgtttaaccgatcgagcatactgtcaatccataagaaaattcacactggtgaaaaaccatataaatgtgaggagtgtggaaaagctttcaaaagatcctctcatctcgccggacacaaacaaatccattccgtgcagaaaccttataagtgcgaagagtgtggcaaggcattcagcatcttttccaccctgactaaacacaagattattcatactgaagagaagccttacaaatgcgagaagtgcggaaagacattttacagattcagcaatctgaatacccataagatcatccacaccggcgagaagccatgcaagtgtgaggagtgcggcaaagcctttaatcactcctccaacctgattaaacacaagctgattcacaccggtgacaagccttataaatgtgaggcctgcggtaaagcttttcgcaggagttctcacttatcccggcacaaaattattcacatcggcattcatacagaagaaacagtacagaagtag

SEQ ID NO: 25386 - DNA, 2325 bp, Artificial Sequence
  Description of Artificial Sequence: Synthetic coding sequence
atgcctggacctccagaatctcttgatatggggcctctgacattcagagacgttgcgatcgagtttagcctggaggagtggcagtgcctcgataccgcccagcaggacttatatcggaaagttatgcttgagaattatagaaaccttgtctttctcgggatagctgtaagtaagccagaccttgtcacttgtctcgaacaggggaaggatccatggaacatgaaggggcatagtaccgtagttaaaccacctgtcatctgcagtcactttgcagaagatttttgtccaggacctggtattaaggactccttccagaaggtcatcctgagggagtatgtaaagtgtgggcacaaggatctgcagcttcgcaaaggctgcaaatctatgaatgaatgtaatgtccacaaggaaggctacaatgaactgaaccagtacctgactaccacccaatcaaaaatctttcaatgcgacaagtacgtgaaggtgttccataagcttctgaatagtaatagacataacacaaagcacactgggaagaaaccattcaaatgtaagaagtgcgggaaaagcttttgtatgttactccatctgtgtcagcataaaaggatccacatccgtgagaattcctaccgctgcgaagagtgtgggaaggccttcatctggttcagtactctcacacgccacaggagagttcacacaggggagaaaagttacaagtatgaatgtggcaagtcattcaatcaggatagcaatctgactacacacaagaggatacacaccggccagaagccttataaatgtgaggaatgtgggacatctttttaccagttttcttatctgacccggcacaaattgatccatacccgcgaaaagccatacaagtgcgagcagtacggaaagacctttaaccagagctccaccctaaccggacacaaaatcatccacaacggtgagaaaccatacaagtgtgaagaatgcggtaaggcattttcgatattctcaacaccaactaaacataagatcattcacaccgaggagaaatcccatcgttgtgaagagtactgcaaagcttacaaggagtcttcccacctgacaactcacaagagaatccacacaggcgagaagccctataagtgtgaagaatgcggtaaggctttcagcatattctcgactcttaccaagcacaagatcatccatacggaggaaaagtcacatcggtgcgaagaatgcgggaaagcttacaaggagagttcccacctgactacccacaaacgtatccacactggcgagaaaccctacaagtgtgaagaatgcgggaaaacattcagcgtcttcagtatcctgacaaagcacaagataatccacacggaagagaagccgtacaagtgtgaggaatgcggcaaggcttttaaacgatcttctactctcactaaacacaggatcatccacaccgaggagaagccatacaaatgtgaggaatgcgggaaggcctttaaccagtcctcaaccctgtcaatccacaagattattcatacaggggaaaaaccatacaagtgtgaggaatgcggcaaggccttcaagaggtccagcactctgaccatccataagatgatccatacaggagagaagccgtataagtgtgaagagtgcggaaaggcttttaaccgctcgagtcatctgacaacccacaaacggattcacaccggccataaaccgtataagtgcaaggagtgcggcaagtccttctctgttttcagcaccctcaccaagcataaaataatacacaccgataagaaaccttacaaatgcgaggaatgtggtaaggcattcaatcggagctccatcctctcgattcataagaagattcacacaggggagaagccgtataaatgcgaagagtgcggaaaagccttcaagcgcagttcccatctcgctggccacaagcagatacatagcgtacagaagccatacaaatgcgaggagtgcggaaaagcatttagtatcttttctactcttactaaacataagataatccacactgaagagaaaccttacaagtgtgaaaaatgcggaaagactttctaccgcttcagtaacctcaacactcacaaaataattcacaccggggaaaagccatgtaaatgtgaggaatgcggtaaggcatttaatcactcttccaatctcattaagcacaagttaatccatacaggagacaaaccatacaagtgcgaggcatgtggtaaagcatttcgcagaagctcgcacctgagtagacacaagattattcatataggtatccatactgaggagacggtgcagaaatag

SEQ ID NO: 25387 - DNA, 312 bp, Artificial Sequence
  Description of Artificial Sequence: Synthetic coding sequence
atgcccggaccgccagaaagcctagatatggggcctcttacatttagggatgtcgccattgaattcagccttgaagaatggcagtgtttagacaccgcacagcaggacctgtaccgaaaggtgatgctggaaaactaccgtaatctggtgttcctggccggaatcgcagtgagcaagcctgacctcgtgacttgcctggaacagggcaaggacccatggaacatgaagggtcactctaccgtggtgaaaccccctgtagagaccggtttccacagatttagccaagacggtctttatctccttacgagctag

SEQ ID NO: 25388 - DNA, 1497 bp, Artificial Sequence
  Description of Artificial Sequence: Synthetic coding sequence
atggagtctccaaggggctggaccttgcaggttgcacctgaggaggggcaggtgttatgcaatgtaaagacagccacccggggtctgtctgaaggtgccgtgtctgggggatggggcgcttgggagaacagcacagaggtgccacgggaggctggcgatggacagagacagcaggctactctcggggcagcggatgaacaagggggacctggacgggagctgggtccagctgatggaggacgagacggcgctggtccccgatctgagccagcggacagggcattaagaccaagtccactgcccgaggagcctgggtgcaggtgcggggagtgtgggaaggctttttcacaaggatcctatttactgcagcaccgtcgagttcatactggggaaaaaccatatacatgccctgaatgtggcaaggcttttgcgtggtcatctaatctatctcagcatcagcggattcacagcggggagaaaccatacgcctgcagagagtgtgggaaggcgtttagggcccatagccaactgatacatcaccaagagacacattcaggactaaagccattccggtgtccggactgtggcaagagctttggacgctcaaccacactggtgcagcacagacgcacgcacacgggcgaaaaaccgtacgagtgcccagagtgtgggaaagctttctcgtggaattccaatttcctcgagcacagaagagtccacaccggcgcaagaccccatgcttgtagagattgcggcaaggctttctcccagtcttctaatttggcggagcatttgaaaatccacgccggtgcacgccctcacgcatgtccagactgtggcaaggctttcgtcagagtggccggtttaaggcagcaccggaggacccacagcagcgagaaacccttcccatgcgcggaatgtggtaaggccttccgtgagtcctcccagctgttgcaacaccagagaactcacacgggagagagacctttcgagtgcgccgagtgtggacaagcatttgtcatgggatcctatctcgccgagcaccggagagtgcacacaggcgagaaaccacacgcatgtgcccagtgtggcaaagcgttcagccagcgatccaacctgcttagtcatagacgaactcattcaggggcaaagcccttcgcgtgcgcggattgtggtaaggccttccgcggttcttcaggcttggcacaccaccggctctctcacacgggcgagcgtccttttgcatgcgcagagtgcggcaaagcgttcaggggaagttccgagctgcgccagcatcagaggctgcactctggagaaagacctttcgtttgtgcccattgctcaaaggcgttcgttaggaagtccgagctgttaagtcatcgacgtacgcacaccggagaacggccatacgcttgtggtgagtgcggcaagccttttagtcaccgatgcaacctgaatgagcatcagaaacgtcacggaggacgcgcagccccttag

SEQ ID NO: 25389 - DNA, 678 bp, Artificial Sequence
  Description of Artificial Sequence: Synthetic coding sequence
cattctggcgaaaagccctacgcatgtagggagtgcggcaaagcgttccgggctcattcacagctgatccatcatcaggagacacactctggcttgaaaccgttcagatgtcccgactgcggaaaaagctttggcaggagcacgaccctggtgcagcacagaaggacccacaccggagaaaaaccctatgagtgccccgaatgtggaaaagcgttcgtccgtgtggccggattgcgccagcatcgcagaacacatagttccgaaaagccttttccctgtgccgagtgtgggaaagctttcagagagagctcgcaactactgcaacatcagaggacccatactggggaaaggccattcgaatgtgcagaatgtggtcaggcattcgtcatgggttcctatttggccgagcatagacgagtccacacaggagagaaaccacatgcctgtgcccagtgtggcaaagcattcagccagcgatcaaatctgctgtcgcatagacggactcactccggagccaaaccattcgcatgtgctgattgcggcaaagcattcagagggtcatcaggactggcccatcatagacttagtcacaccggggaacgcccttttgcttgcgctgagtgcggcaaggctttccgcggttcgtccgagttgcggcaacaccaaagactccattag

SEQ ID NO: 25390 - DNA, 1497 bp, Artificial Sequence
  Description of Artificial Sequence: Synthetic coding sequence
atggagagccctcgaggctggaccctacaggtggctccagaggaaggccaggttctgtgtaatgtgaaaacagccacacgaggcttgtcagagggagcagtgtccggtgggtggggcgcatgggagaattctaccgaggtgcctcgcgaggccggagacggccagcgccaacaagccacactgggggcagcagacgagcaaggcggaccgggtcgggagctcgggccagctgacggtggaagggatggcgcaggtccgagatctgagcccgctgaccgcgcattgagacctagccccctcccggaagagcctggttgccgatgcggggaatgtggcaaggccttcagtcaggggtcttacctgctgcagcatcggagagtccataccggggagaaaccctacacatgtccggaatgtgggaaggcctttgcctggtcatcaaacctctctcagcatcaaagaatacattcaggcgaaaagccttacgcctgtcgcgagtgtggcaaggcatttagggcccattcacaactcatccatcaccaggagacccattctgggttgaagccattccgctgtcccgactgtggaaagagcttcgggagaagcaccacactggtacaacatagacgcactcacacaggagaaaagccatacgaatgcccagagtgcggcaaagcatttagctggaatagcaattttctagagcatcgacgggtccataccggcgcacggccacacgcctgccgggattgtgggaaagcattttctcagtctagcaacctcgccgagcacctgaagatacatgccggtgcccgaccccacgcctgtcctgattgcggcaaggcattcgttcgggtggccggtctgagacaacaccgacggacccacagctccgagaaaccatttccttgcgccgagtgcggtaaagcctttagagaaagcagccagctgctgcagcaccagaggactcacaccggggaaaggcctttcgagtgtgcagaatgcggacaggcctttgtaatggggtcttacctcgcagagcacaggagagtgcatactggcgagaagccccacgcatgcgcccagtgcgggaaagccttctctcagaggtctaatctgttatcccataggaggacccactccggggctaagccattcgcctgtgcagattgcggcaaggcctttcggggaagtagcggcctggctcatcataggcttagtcatacaggcgaaagaccattcgcctgtgcagagtgcgggaaggcttttcgcggtagttctgagctccgccagcatcagcggctgcattccggagaaaggccttttgtctgtgcccattgctccaaggcctttgtcaggaagagcgagttgctctcccatcgcaggactcacactggcgaacgaccttatgcatgcggagagtgcggcaaacctttctctcaccggtgtaatctgaatgagcaccagaagcgacacggcggtagggcggcaccttag

SEQ ID NO: 25391 - DNA, 1419 bp, Artificial Sequence
  Description of Artificial Sequence: Synthetic coding sequence
atgctcaaggaacatcccgagatggcagaggcacctcaacagcagctcgggatccccgtggtgaaattagaaaaagaactgccttgggggagaggcagagaagatccaagtcctgaaacatttagattgcggtttaggcaattcaggtatcaggaggcagcgggacctcaggaagctctgcgcgagctccaggaactgtgtcgacgttggctgcgcccagaactccataccaaagagcagattcttgagctgcttgtgttggagcagttcttaactattttgcccagagaattttacgcgtggatccgggagcacggcccagaatcagggaaggcccttgccgctatggtggaggacctaactgaaagggcgctggaagcaaaagccgtaccctgtcataggcagggggaacaagaggaaactgcactgtgccggggagcctgggagccaggtatacagctggggcctgttgaagtgaagccggagtggggcatgccacctggggaaggagtccaagggccagaccctgggacagaagaacagctgtcacaggatccaggcgacgagactcgggctttccaagagcagggcggaggatccaaagaaaaagaggcaaaacccccacaggaagatttgaagggggcactagtggctctgacaagcgagcgctttggcgaggcctcccttcagggccctggtctggggagagtttgcgaacaggagcctggaggcccagctgggtctgctccgggactgccaccaccccaacacggtgcaattcctctgccggatgaggtgaagacacattcttccttttggaagccattccagtgccctgagtgtggcaaggggttcagtaggagttccaatctcgtacggcaccaaaggacacacgaggaaaagagttatggctgtgtagagtgcggcaaaggatttacactacgagaatacttgatgaagcatcagaggacccacctgggcaagcggccatacgtgtgtagcgaatgctggaagacctttagccagcggcatcatcttgaagtgcaccaaagatctcacaccggagagaagccctacaagtgtggggattgttggaagtctttttcccgtcggcagcatcttcaggttcatcgcaggacccataccggggagaagccatacacttgtgagtgcggtaagagctttagtcgtaatgccaacctggccgtccacagacgggcacatacgggggagaagccttacgggtgtcaggtctgtgggaagcgattttcaaaaggtgagaggttggtcaggcaccagagaatccatacaggagagaagccttaccactgcccagcatgtggacgcagtttcaaccagcgctcaatactgaaccgccaccaaaaaacgcagcaccgacaagaacctttggtccagtag

SEQ ID NO: 25392 - DNA, 1635 bp, Artificial Sequence
  Description of Artificial Sequence: Synthetic coding sequence
atgctaaaggaacaccctgagatggctgaagcaccccagcagcagctaggcattcctgttgtgaagctcgaaaaggaattaccctggggacggggacgggaggacccctcccccgagacttttcgcctgaggttccggcagttccggtaccaggaagctgccggaccacaggaagctctacgggaacttcaggagctgtgtaggcgctggttgcgacccgagctccacacaaaggagcagattctcgagctactcgtgcttgagcaatttctaactattctccccagagagttctatgcctggatccgcgaacacggccctgagagtggaaaggctctagccgctatggtggaagatctgaccgagcgggcactcgaggctaaagctgttccctgtcacagacagggcgagcaggaggagacagctctctgccgcggagcatgggagccaggcatccagctgggccctgtggaggtgaaacccgagtgggggatgcctccgggagaaggcgtgcaggggcctgatcccggtaccgaggaacagctgtcccaggacccaggcgacgaaaccagggcctttcaggagcaggctctgcctgtgctgcaggcaggccctggcctccccgcagtgaaccctcgggaccaggaaatggccgctggcttttttaccgcaggatcacaaggcctggggcctttcaaggacatggctcttgcctttcctgaagaggaatggcgtcacgtcacacctgcacagattgattgctttggggaatacgtggagccacaggactgtagggtgtcaccgggaggcggttctaaagaaaaagaggcgaagccaccccaagaagatttgaaaggtgcactcgtggcgctcaccagtgaaagattcggtgaggcttcattgcagggtcccggactcggccgagtttgcgaacaggagcccggagggccagccggttcggcccctggactaccccctccacaacacggagcaataccactgcccgacgaggtcaaaacacacagtagtttctggaagccttttcagtgcccggagtgcgggaaaggcttctccaggagcagcaacttggtgaggcatcagcggacacatgaagaaaagtcatacggatgcgttgagtgtggcaaaggctttaccctgcgagaatacctcatgaaacaccagagaacacatcttgggaagaggccatatgtatgctcagagtgctggaagactttctcacagagacaccaccttgaggtccaccagaggtctcacacgggagagaaaccttataagtgtggcgattgttggaagtctttttctagaaggcaacacttgcaggtgcaccgcagaacacacactggtgagaagccttatacgtgtgaatgtggaaagagcttttcacggaacgccaacctcgcggtgcatcgacgagcccataccggtgagaaaccctatggatgccaggtatgcggaaagcgcttctctaagggtgagcgccttgtcaggcaccagcgcatccataccggggaaaaaccctaccattgccctgcatgtggtaggtctttcaatcagaggtcgattctgaacaggcaccagaaaacccagcaccgacaggagccactggtccagtag

SEQ ID NO: 25393 - DNA, 1635 bp, Artificial Sequence
  Description of Artificial Sequence: Synthetic coding sequence
atgctgaaagaacatccagagatggcagaggccccacagcagcagctggggatccctgtagttaagcttgagaaggaactcccgtgggggaggggcagagaagacccctcacctgaaacatttcgcttgaggttcagacagtttaggtaccaagaggccgctgggccacaggaagcattgcgggagctgcaggagttatgccgtcggtggctgcggccagagctgcataccaaggaacagatcctggagttgctggttctcgagcagtttctcacaatcctccctcgcgaattctatgcatggatccgggagcatgggccagagtctggaaaagccctcgcagccatggtcgaagatctcaccgaaagggccctcgaggctaaggccgtcccctgtcatcgccagggcgagcaggaggagaccgccctttgccggggtgcttgggaacctgggatacagctgggcccagtcgaagtgaagcccgaatggggcatgcctcctggagagggggtacaaggcccagacccaggcactgaggaacagctttcccaggacccgggagacgagaccagggcatttcaggagcaggccctgccagttcttcaggctggcccaggtctgcccgcagtgaaccccagagaccaggaaatggccgctgggttcttcacggccggaagccaagggctgggaccttttaaggatatggcgttagcctttcccgaggaagagtggcggcacgtgacacccgcacagatcgactgtttcggcgaatacgtggagccgcaggactgccgagtaagcccaggcggaggcagcaaagaaaaagaagccaagccaccccaggaggatctcaagggcgctttggtggctctgacttcagaacgattcggtgaagcctcccttcagggacccggactcggacgagtttgtgagcaggaacccggtggacctgcgggatcagccccagggcttccaccaccacagcacggggctatacccctccctgacgaagtgaagacacattctagcttctggaagcccttccagtgcccggaatgtgggaagggttttagcaggagctccaatcttgtcagacaccagagaacgcatgaagagaaaagttacggatgtgtggagtgtggcaagggcttcacactgagagaatacttgatgaaacaccaaaggacccatctcgggaaacgtccatacgtgtgtagcgagtgctggaagaccttttcacagagacaccatctggaggtgcatcaacggtctcacaccggagaaaaaccatacaagtgcggtgactgctggaagtccttttcaagacgacagcaccttcaagtgcatcgtagaacccatacaggagagaaaccttatacttgcgagtgtggcaaatcttttagcaggaacgcaaatttagcagtgcaccggagagcacacacaggagagaagccttatggctgccaggtttgcgggaaaaggttcagcaagggcgagaggcttgtgagacaccaacgcatccacactggggaaaaaccctaccattgcccagcctgtggaaggtccttcaaccagcggagcattctgaatcggcaccagaaaacccaacacaggcaggaacccctggtccaatag

SEQ ID NO: 25394 - DNA, 213 bp, Artificial Sequence
  Description of Artificial Sequence: Synthetic coding sequence
atgctaaaagagcatccagagatggctgaggccccacagcagcagctcggcatccctgtcgtgaaattggaaaaggaattaccctggggacgaggtcgggaggatcctagtcctgaaacgtttcgtctgaggtttcggcagtttaggtatcaggaggccgctggtcctcaagaggctctccgggaactgcaggagctgtgtcgtcgttggtag

SEQ ID NO: 25395 - DNA, 5424 bp, Artificial Sequence
  Description of Artificial Sequence: Synthetic coding sequence
atggcgaagcctacctcgaaggactcagggctgaaggaaaaattcaagattcttctgggactgggtacgccacgtccgaaccccagaagcgcggagggcaagcaaactgagttcattatcacagcagagatcttgagggaattatccatggagtgcgggctgaataaccgtatccgcatgataggacagatatgcgaggtggcgaagacaaaaaaatttgaagaacatgcggtggaggcactttggaaggccgtggccgaccttttgcagccagagagacctttagaggccaggcatgcagtgctggcactcctgaaagccatcgtgcagggccagggcgaacgattgggagttctcagagcactcttcttcaaagtcatcaaagactatcccagtaacgaagacctgcatgagcggctggaggtcttcaaggctctgaccgataacgggaggcacataacatatctggaggaagaactggctgacttcgtcctccagtggatggatgtaggtctttcaagtgagttcctactcgtcctggtcaacctcgtgaagtttaatagctgttatctcgacgagtacatcgctcgcatggttcagatgatttgcctgctctgtgtgagaacagcatctagcgtagatattgaagtgagcctccaggtcctcgatgccgttgtatgttacaattgcctgcccgcagaatcgcttcctctgtttatcgtgacactttgtaggacaatcaatgttaaggagctttgtgagccctgctggaaactgatgcggaatttactaggtacccacctcggtcactccgctatatataacatgtgtcatcttatggaggaccgcgcatacatggaagacgcgccacttttacggggtgcagtgttcttcgtcggtatggctctgtggggggcacacagactttattctctccggaacagcccaacgagcgttctgcccagtttttaccaggctatggcatgtcccaatgaggttgttagttacgagatcgtgttgtccattacccggttgatcaaaaagtataggaaggagctgcaggtcgtcgcttgggatatcctgcttaatatcatagaaagattactgcaacagctgcagactctggactcaccggagttaaggaccatcgtacacgacctgctgaccaccgtcgaggagctctgtgaccagaacgaattccacggatcccaggagcggtacttcgagctcgttgagaggtgcgccgatcagcgcccagaatcttctctcctaaacctcatttcctatagggcgcagagcatacatcctgcgaaggatggttggatccagaacctccaagctttgatggaaagattcttccgctctgagtctaggggagccgtccgcatcaaggtgctcgatgtgttgagctttgtcctgctgatcaacaggcagttctacgaggaagaactcattaatagtgtcgtcattagtcagctgtcccatatcccagaggataaggatcaccaggtgaggaagctagctactcagctcctggttgatttagcagaggggtgccatacacatcattttaattccctactggacatcatcgagaaagtgatggcgagatccctctctcccccaccagagctcgaggagcgagatgtagctgcttattccgctagcctggaggacgtcaagactgcagtgctgggactcctggtgatcttacagacaaaattgtataccctcccagccagccacgccacacgcgtttatgagatgctggtttctcatatccagcttcattacaaacatagctacaccttacctatcgccagtagcatccgcctccaggcattcgattttctactgttgctgcgagccgattcccttcaccgcctgggtctacctaataaggacggggtggttagatttagcccttactgcgtctgtgattatatggaaccggagcggggatccgaaaagaagacgtctgggcctctgagccctccaaccggaccaccgggaccagcccctgcaggtcccgctgtgcggcttgggagcgtgccttactccctgctgttcagggtgttgctgcagtgtttgaagcaagagagtgactggaaagtgctgaagctggtgcttggacgcctgcccgaaagcttgcgctataaagtgcttattttcacaagtccttgctcagtcgatcagctgtgttcagccctgtgcagcatgctttccggaccaaagactttagagcggctgcggggtgcgcctgagggattcagtcggaccgatctccacctagcggtggttccagttctcaccgcactgatctcctatcataattacttagacaagacaaagcaaagggagatggtgtattgtttagagcagggactgattcacaggtgcgcgagccagtgcgtggttgccctgagtatctgctccgtggagatgcccgatatcatcatcaaggcactacccgtgctagtcgtaaagttgacacatatctccgctaccgcatccatggccgttccactcttggaattcttatccaccctggcgagactgccccatctgtatcggaatttcgccgcagagcaatacgcatccgtcttcgcaatcagtctgccctacactaatcccagcaaatttaatcaatatatagtgtgcctagcccaccacgtgatcgcaatgtggtttatccgttgccgactgcctttccgcaaggacttcgtacccttcattactaaaggcctgcgatcaaatgtgctcctgtcctttgacgatacacctgaaaaggatagtttcagggccagatcaacgtcccttaatgagaggcccaagtccttgcgaattgcccgtccgccaaagcagggtctgaataattctccccctgttaaagaattcaaagagtctagtgctgcagaagccttcaggtgccggtcaatctccgttagtgaacacgtcgtacggagtcggattcagacaagcctgacctccgccagccttggctccgcggacgaaaactccgtcgcccaggccgacgattctctcaaaaatcttcatctggaactcactgagacttgcctggacatgatggctcggtacgtatttagtaacttcacagcagtaccaaaacgtagtcccgttggcgaattcctcttagcaggtggacgcaccaagacatggctcgtcggaaacaagcttgtgaccgtgacgacctcggtcggcactggtacacgcagtctgcttggcttggattccggcgaacttcagagcgggccagagagtagcagctctcctggcgttcacgttcggcagaccaaggaggcgcctgccaagctggaatcccaggcaggacagcaggtcagccgaggggcaagagacagggtgaggtccatgtccggtgggcatggcctgcgcgtgggggctttggacgtcccagctagccagtttctggggtctgctacatcacctggccctaggacggcccctgctgccaaacctgagaaagcctccgcgggtacccgagtcccagtccaagagaagacgaatctagctgcctatgtacctctcctgactcaggggtgggcagaaattttagtgcggcgaccaacaggcaacactagttggctaatgtccctggagaatcccctgagcccgttttcatccgatatcaacaatatgccactacaagaattaagtaacgctctgatggctgctgagagatttaaggagcaccgagacactgccttgtacaagagcctgagtgtgccagccgcaagtaccgcaaaaccgccacccctccccagatctaacaccgtagcatccttttcaagtctgtatcagtcatcttgccagggacagctccacagatccgtctcctgggccgactccgctgtggtgatggaagaagggtcaccaggagaagtaccagtgctggtcgagccaccgggattggaggacgttgaggccgctctcggcatggacaggaggactgacgcttacagcagaagtagctctgtatcatcgcaggaagagaagagtctacatgccgaagaactcgtgggcaggggcattcctattgaaagggttgtgtcttccgaggggggacgcccttccgtggacctgagcttccagccttcacagcccctgagtaagtctagctcgagcccagagcttcagacactgcaggacatccttggagatccaggtgacaaggccgacgtgggacggcttagccctgaagttaaggcgcgatcccagtcaggaaccttggacggggagtccgctgcctggtcagccagcggcgaagattctcgtggacagccagagggccctctacccagctcgtccccccgtagtcctagtggccttcgccctcggggatatacaattagtgactctgccccttctcgacgcggtaagcgtgtggaaagggacgccttaaagtcccgtgccaccgccagtaatgctgagaaggtcccaggcatcaaccccagctttgtctttctgcagctctaccactctccttttttcggtgatgagagcaataagccaattttactgccaaatgagtcacagtcattcgagcgctcagttcagcttctggatcaaataccatcgtatgatacccataagattgctgtactgtatgtaggggagggccagagtaatagcgaattggctatcctgagcaacgagcatggaagctatcggtacacagaatttctgacaggactggggaggctgatcgagctcaaagattgtcagccagacaaagtttacctggggggacttgatgtgtgcggcgaggatgggcagtttacatattgttggcacgatgacattatgcaggccgtgttccatattgcaacactaatgcccaccaaagatgtggataaacatagatgtgacaaaaaaaggcaccttgggaacgactttgtttctatagtctacaatgatagcggcgaagacttcaagttgggtaccatcaagggacagtttaattttgtgcatgtaatcgtaacaccactggattacgagtgcaacctggtctcactgcaatgtaggaaggatatggagggactcgttgacacaagcgtggcaaagatcgtatccgatcggaacctgccatttgtggctaggcagatggcgctgcatgcaaatatggcaagccaggtacatcattcaagaagcaacccaaccgatatatacccaagcaaatggatcgctaggctgaggcatatcaagcgtctgcgacagcgaatttgtgaggaagccgcttatagtaaccccagcctgccgctcgtgcatcctcctagtcattccaaggccccagctcagacacccgcagagcctactccaggttacgaagtgggccaacggaagagacttatttccagcgtggaggacttcacagaattcgtttaa

SEQ ID NO: 25396 - DNA, 1326 bp, Artificial Sequence
  Description of Artificial Sequence: Synthetic coding sequence
atggccaccgtccctggtttgcagccacttcccactcttgagcaggatctcgagcaggaggaaatcctcatcgtgaaggtggaagaggacttttgtctggaggaggagccatccgtggagaccgaagatccgagccctgaaaccttcagacaactgtttcgcctcttctgctatcaggaggttgctggccctagagaggctctcagcaggctatgggagctatgttgccgctggttacgccctgaactaagaactaaggagcagatactggagctgctcgtcctagagcagtttctcactgttctgccaggcgaaatccaagccagggtgcgcgagcagcagcccgagtccggggaggaggccgtcgttctggtagaggggctgcagcggaagccaaggaagcaccgacaacgaggctccgagctgcttagtgatgatgaagttcctttgggcatcggaggacagttccttaaacaccaggccgaggcacagcctgaggacctgtccctagaggaggaagcccgattttcaagtcagcagccaccagcccagcttagtcacaggccccagagaggtcccctgctttggccagaacgcggaccgccagcccctcggcaccaggagatggcatccgcctcgcccttcctgagcgcttggagccaagtccccgttaacctggaggacgtcgcagtctacctttctggagaggagcctaggtgtatggatcctgcccagcgcgacgccccactggagaatgagggtcctggaatccagcttgaggacggaggcgatggacgagaggacgcccctctccgcatggagtggtatcgggtgttgagcgcgaggtgccaagggccagggcaccctctgccaggccagcgaccggctccagtgagagggctcgttcgcccagatcagccaagaggaggccctcctccaggccgtagagccagtcacggggctgacaagccgtacacttgccccgaatgcgggaaagggttctctaagactagccaccttacaaagcatcagaggacacatacaggcgagcggccttataaatgcctcgtatgcggcaaggggttttccgatcgctccaactttagtacgcaccaacgagtgcataccggagagaaaccgtacccatgcccagagtgcggtaaacgtttttcccagtcctcctcactggtgattcaccgccgaacccattcaggtgaacggccatatgcctgcacccaatgtggcaaacggtttaacaatagctctcatttctcagcacacaggagaacacacaccggacacatcttaaggtccggctgcacgtag

SEQ ID NO: 25397 - DNA, 648 bp, Artificial Sequence
  Description of Artificial Sequence: Synthetic coding sequence
atgaattcctcacagatcagcctgaggatgaagcacggcagggttaacatgcagaaaaagccctctaaatgttcggaatgcggaaaattctttacacaaagaagctcattgacccaacaccagcggattcatcggggagagaaaccatacgtctgctccgaatgtggatcctgttttcgaaaacagagtaatctgacccagcacttgcggattcacacaggggaaaaaccctacaagtgcaatgagtgcgaaaaggccttccagacaaaagctattctcgttcagcacctgcgaatccatacgggcgagaaaccttacaagtgcaatgaatgtggcaaggctttctgtcagtccccctcactcattaagcatcaacggatccatacaggtgagaagccctatacctgtaccgagtgtgggaaagccttcacccaaaactcttctctggtcgagcatgaacgaacacatactggggaaaagttatacaagtgcagtgaatgtgaaaagacctttcggaagcaggctcatctcagcgaacattacagaattcacacaggcgagaagccctatgagtgtgtggggtgcggcaaatccttccgccactctagcgcccttctccgccatcagcgtttacacgcaggagagtag

SEQ ID NO: 25398 - DNA, 816 bp, Artificial Sequence
  Description of Artificial Sequence: Synthetic coding sequence
atgaactcctcccaaatcagtcttagaatgaagcacggaagggttaatatgcaaaagaaaccttcaaagtgtagcgagtgcggcaaattcttcacccagagatcctctttgacacagcaccaacggatccacaggggagagaagccgtatgtgtgtagtgagtgcgggagctgtttccgaaaacagagcaacttgactcagcacctaagaatacacaccggcgagaaaccttataagtgcaacgaatgtgagaaggcctttcaaactaaagcgatccttgtccagcaccttaggatccacacaggggaaaaaccgtacaagtgcaatgagtgcggcaaggctttctgccaaagccccagcctgatcaagcatcagcgtatacacaccggcgagaaaccatataaatgcacagagtgtgggaaggcattttctcagtcaatctgtctgactagacaccagcggtcacactccggcgataaaccctttaagtgcaatgagtgtgggaaagcatttaatcagtctgcctgcttaatgcagcatcaacgtattcacagcggcgagaaaccttatacctgcaccgagtgcggcaaggcgtttacccagaacagttctttagttgagcacgaacggacccatactggggaaaagttgtataaatgcagtgagtgcgagaaaacattccggaaacaggcacatctgtctgaacactatcgcatacacaccggagagaaaccgtatgagtgtgttggctgcggcaagtcttttaggcattcatctgcactgctacgacatcagagacttcacgcaggggagtag

SEQ ID NO: 25399 - DNA, 1635 bp, Artificial Sequence
  Description of Artificial Sequence: Synthetic coding sequence
atgctgaatatgcagggcgcagaggaacgcgatattcgcagggagacgtgccccggatgggtgaacaaaaacaaaccggctctcgagcaggatgtctgcaagattgattcatctggcattgtcgtgaaacgattccaggaggatgaatatcaagattcaacattcgaggagaaatatgcatgcgagggcatgaaagaaaactctccccgagagattgccgaaagttgtctatttcaggaaggcggtttcggtcgcatcacattcattcacaaagaagcaccgcctgagatcatcagtcagggctacaacttcgagaaatcgctgctccttactagcagtctggtcacgcggctgcgcgtgtcaacagaagaaagcctgcaccaatgggagacgagtaacatccagactaatgatatcagcgaccagtccaaatgtccaaccttgtgcacccagaagaagagctggaaatgcaatgaatgcggaaaaaccttcacccagagctccagccttacccagcaccagagaacacataccggggagcgcccttacacctgtgaagaatgtgggaaggctttttctcggtccagctttctggttcagcaccagagaatccacactggagtcaagccctatgggtgcgagcaatgcggaaagacatttcgctgccgctcctttctgacacaacaccagagaatccacacaggggagaagccatataaatgtaacgaatgcggcaactcttttcgtaatcacagtcacctcacggagcaccaaagaattcacacaggggaaaagccttataaatgcaatcggtgcggaaaggcattcaaccagaacactcatctgatccatcaccagagaatccacacaggagagaaaccgtacatctgttccgagtgcgggtcatccttcaggaaacactctaaccttacccaacatcagcgaatccacactggtgagaagccacataagtgcgacgagtgcggaaagacgtttcagaccaaagccaatcttagtcagcatcagaggatccactccggagagaagccttataagtgcaaggagtgcggaaaggccttctgccaatcgcctagccttatcaaacaccagcggatacatactggcgagaagccttacaagtgcaaagagtgcggaaaggcttttactcaatccactcctctaactaaacaccagaggattcacacaggtgaaagaccctacaagtgctccgagtgcgggaaagccttcatccagtcaatctgcctaattcggcaccagcgctctcatactggtgaaaagccttataaatgtaatgaatgtgggaaaggattcaaccaaaatacctgtctgacccagcacatgagaatccataccggcgaaaagccctacaagtgtaaagagtgcggcaaagccttcgctcatagctcttctttgactgaacatcaccgcacacacaccggcgaaaagctctacaaatgctctgagtgcgagaaaactttccggaagtacgcacatttgtccgagcactaccggatccatacaggggaaaaaccgtatgaatgcatagagtgcggcaagttctttaggcatagttcagtgctgttccgacatcagaagttacattcaggagactag

SEQ ID NO: 25400 - DNA, 468 bp, Artificial Sequence
  Description of Artificial Sequence: Synthetic coding sequence
atgctgaacatgcagggggcagaagagagagatattagacgggagacatgcccaggatgggttaataaaaacaaacctgcactcgagcaggacgtttgcaaaattgacagttccggcatagtcgtgaagcgttttcaagaggacgagtaccaggattcaacctttgaggaaaaatatgcctgcgagggtatgaaggagaactccccacgtgaaatcgcggaatcttgtttgtttcaggagggcggattcggcaggattacctttattcacaaagaggccccaccggagatcataagtcagggttacaacttcgagaaatctctcctactgactagttcacttgtcacacgactgcgggtgagcacggaggaaagcctacaccagtgggagacctcaaacattcaaactaatgacatctcagatcaatctaaatgtcctacattgtgcacccagaagaagagctggtag

SEQ ID NO: 25401 - DNA, 1362 bp, Artificial Sequence
  Description of Artificial Sequence: Synthetic coding sequence
atgctgaatatgcagggagcagaagagagagacatcagacgggagacttgccctggctgggtgaacaagaacaagcctgccttggaacaagatgtctgtaagatcgatagctccggtattgtcgtgaagcggttccaggaagacgaataccaggacagcacattcgaggagaaatatgcgtgcgaaggtatgaaggaaaatagccccagggaaattgcagaatcttgcctgtttcaggaagggggattcggcagaattactttcattcacaaggaggcacctcctgagattattagccagggctacaactttgagaagtcactgctgcttacatcatctctggtgactcgtctgcgggtaagcactgaggagtctctgcatcaatgggaaacgagcaatattcagactaatgacatctcagaccaatcaaagtgcccgacactgtgcacacagaagaaatcctggaagtgcaatgaatgcgggaagactttcacccagtcgtcctccctgactcaacatcaaaggacgcataccggtgagcgaccttacacgtgcgaagagtgtggaaaggctttttcccgcagctcatttctagtgcagcatcagcggattcataccggtgtgaaaccgtatggatgtgaacagtgtggcaaacatttcgatgtggatcactttcttctctccattaaagagttcacacttgaacggaaccttatcaacgctatgaacgtgggtattcctagcgcgatcacacatatttccttgaacacccgcgaattcacactcgagaggaacctaatcaacgccattggtgtgggtaggcattccatccgcattcataccctgttcatcattcgggagttcacactggtcaggtcgctgacctatgcagtgaacgtagctctgctctttgaaaatacccagatcctgcgcaatattcgggaatttacactgggcaagaaccctataaatgtcaccaatgttggcaagttgtctaaacagaggcagactagcttatctattagggagttcatcgttgaaaggaaccccatcaacgtgaagaacgtcgctaagccatttgttagagctcacctgctgttaaacacctccgaattcattctagagaaaaaccacatcagcgtaaaaaatgtggctaagagactgctgcgggctccacactctctcaacattcgggagtatattcaggggagagatccaactaatgcggttaatgtggtgaagccatcatttcgagcctttgccctgttcggcacacgggaagttaccctagagaaaaatcccatcaacgctatgaatgtggaacgggcactgattcgaactccagcgtctctatccatttag

SEQ ID NO: 25402 - DNA, 1635 bp, Artificial Sequence
  Description of Artificial Sequence: Synthetic coding sequence
atgcttaacatgcagggtgccgaagaacgggacattcggcgtgaaacctgcccgggatgggttaacaagaacaagccagcgttagaacaggacgtttgcaagatcgacagctctgggatagtggtaaagaggttccaggaggatgaataccaggacagtacattcgaagagaaatatgcctgtgagggcatgaaagaaaactctccacgggagatagctgagagctgcttgtttcaagaagggggatttggtcgcattactttcattcataaagaggcccctccagaaatcatttcccagggttataacttcgagaaatccttgctgctgacctcaagcctggtgacccggctgagggtatccacagaagagtccttgcaccaatgggagacgtccaatattcagaccaatgacatctctgaccagagtaagtgccccactctctgtactcaaaaaaaatcctggaagtgtaacgagtgtggcaaaacctttacacagtctagtagcctaacccagcatcaacgcactcacactggggagcggccatacacctgcgaggagtgtgggaaagcattcagcaggagcagctttctggtacagcaccaacggatccatactggagtgaaaccatacggctgcgagcagtgcggtaagacttttcgctgccggtcttttctgacccaacatcagcgaattcatacgggcgagaagccatataaatgcaatgagtgcggtaattccttcaggaatcacagccaccttaccgagcatcagcggatccacacgggagaaaagccctataagtgcaataggtgcggtaaggcgttcaaccaaaacacccatctcatccatcaccaaagaattcacacaggggagaagccgtatatttgttctgaatgtggatcatcgttccggaagcactctaatctcacacagcatcagcggattcataccggcgaaaaacctcacaaatgcgatgaatgtggtaagactttccagactaaagccaacctgtcacagcaccaaaggatccactcaggagagaagccatacaaatgtaaggaatgcgggaaggcattctgtcagtcgcctagcctgatcaaacaccaacggatccacaccggtgagaaaccgtataagtgtaaggaatgcggaaaagcattcacacagtccactccactgaccaaacaccagcggattcacaccggcgagcgaccttacaaatgctccgaatgtggcaaggctttcattcaatcgatctgcctcatacggcatcagagatctcacaccggcgagaagccttacaagtgcaacgagtgcggaaagggttttaaccagaacacctgtcttacgcagcatatgcgtatccacacaggggagaaaccctacaagtgcaaagaatgtgggaaggcctttgcccacagttctagcctgactgagcatcataggacccataccggagagaaactctacaagtgctcggaatgcgaaaagactttcaggaaatacgcccacctgtcagagcactaccgcattcacactggcgagaagccttacgaatgtattgagtgtggtaagtttttcagacattcgtccgtgttatttaggcatcaaaagttacactcaggggactag

SEQ ID NO: 25403 - DNA, 1635 bp, Artificial Sequence
  Description of Artificial Sequence: Synthetic coding sequence
atgctgaacatgcaaggcgcagaggagagagatatacgaagagagacttgtcctggctgggtgaataagaataagccggcactggagcaggacgtctgcaaaatcgactcctccgggattgttgtgaagcggttccaggaagatgagtatcaagattccaccttcgaagagaaatatgcctgtgagggcatgaaggaaaacagtcctcgggagatcgcagagtcttgtctgtttcaggaaggaggatttggccgaatcaccttcattcacaaagaggcacccccagagatcatttctcagggttacaatttcgagaagtccctgcttcttacttccagtctggtgactcggctgagagtctcaacggaagagagcctccaccagtgggagacttcaaacattcagaccaatgacatctccgatcagtcaaagtgcccaaccctctgtacacagaaaaagtcttggaaatgtaacgagtgtggtaagaccttcacacagtcttccagcctgacccagcaccaaagaactcatacgggagaacgcccttatacatgcgaagagtgcggaaaggctttcagccgcagttcttttcttgtccagcaccagcgaattcacactggggtcaagccgtacgggtgcgagcagtgtggcaagacattccgctgtcggagctttctcactcagcatcagcggatccatacaggtgaaaaaccttataaatgtaacgaatgtggcaactccttccgcaatcactcccacttgacagaacatcagagaattcacacgggcgagaagccatataagtgtaaccgctgtggaaaggcatttaaccagaatacacatttgattcatcatcagcgcatccacaccggcgaaaaaccatatatctgctcggagtgtgggtcttcgttccgcaaacacagcaacctgacacagcaccagaggatacacacaggagaaaaaccacacaagtgtgacgagtgtggcaagacatttcagacaaaagctaacctgtcacagcatcaaaggatacactctggtgagaaaccttacaagtgtaaggagtgcggaaaagctttttgccagtctcctagcctgatcaagcatcagaggattcacaccggagaaaagccctacaaatgcaaggaatgtggtaaagcttttacccaatctacccccctcacaaaacatcaaagaatacataccggtgagcgcccatacaagtgttccgagtgtggaaaggcattcatccagtccatctgtctgatccgacaccaacgcagtcacacaggggagaaaccttacaagtgcaacgagtgtggcaagggattcaatcagaacacttgtctaacacaacacatgagaattcacactggagaaaaaccgtataaatgtaaggaatgcgggaaggctttcgcgcatagcagtagcctgactgaacaccaccgcacacataccggggagaaactttataaatgctctgaatgtgaaaaaacatttagaaagtacgctcatctcagtgagcattatcgtatacataccggagagaagccctatgagtgcattgaatgcggcaaattttttcgccatagtagcgtcctgttccgacatcagaagcttcacagcggggattag

SEQ ID NO: 25404 - DNA, 1335 bp, Artificial Sequence
  Description of Artificial Sequence: Synthetic coding sequence
atgggacctctccagttcagagatgtggcaattgaattttccctggaagaatggcactgtttggatgccgctcagcgaaacctgtaccgggacgtgatgctggagaattacagaaatctgattttcctgggtatagtggttagtaagccgaacttaattacctgtctggagcaaggtaagaaaccattgacgatgaaaagacacgagatgatcgcgaaaccaccggtcatgtatagccacttcgcccaggacctttggtctgagcagagcattaaagacagttttcaaaaagtcatattgcgcagatacgaaaagtgtcggcacgacaatttacaactgaagaaaggctgcgaatccgtcgatgaatgcccagttcacaaaagaggttataacgggctgaagcaatgtcttgcgacaacccagaggaagatattccagtgcgatgagtacgtcaaattcttacataagtttagtaacagcaataagcacaagatccgtgacaccggtaagaagtccttcaagtgcatcgagtacggcaagacattcaatcaatcctcaaccaggaccacgtacaaaaagattgacgctggggagaaacgctacaagtgcgaggagtgcggtaaagcctacaagcagtctagccatctgactactcacaagaagatacatacaggagaaaaaccttacaagtgcgaagaatgtgggaaagcttataaacagtcttgtaacctgaccactcataagataattcatacaggtgaaaagccctatagatgtagagagtgcgggaaagcattcaatcaccccgcaactctcttctctcacaaaaagattcatactggagaaaagccgtacaagtgcgataagtgcggaaaagcgttcatctcatcctctacacttacgaagcacgagattatccataccggggaaaagccttacaagtgcgaggaatgcggaaaggctttcaatcgctcaagcaatctgacgaagcacaagcgcattcacacaggggatgttccctataagtgcgacgagtgcgggaagaccttcacctggtatagctcgctctcaaaacacaaacgagctcacacgggggagaaaccgtataagtgtgaagagtgtggtaaggcctttaccgctttcagcacacttaccgaacacaaaataattcacaccggggagaagccttataaatgcgaagagtgcggcaaggcctttaactggtcttccgcacttaacaaacataagaagattcatataagacagaaaccttgcattgtcaagaacgttgagaacttactgaatgtgccccagccactcatctcaatccggtag

SEQ ID NO: 25405 - DNA, 1239 bp, Artificial Sequence
  Description of Artificial Sequence: Synthetic coding sequence
atggggccattgcagttccgagacgtagcgattgaatttagtttggaagaatggcactgcttagatgcagctcaacgtaacctgtacagagacgtaatgctcgaaaattatcgcaacttgatctttctggtaatgtactctcatttcgcccaggacttgtggtcggaacagtcaattaaggattccttccagaaagtgattttaaggaggtacgaaaaatgccggcatgacaacctccagctgaagaagggatgtgagagcgtggatgaatgccccgtccataaacgcggatacaacggactgaagcagtgtctcgccactactcagcgaaagatcttccaatgcgacgagtatgtcaaatttttgcacaaattctcaaactccaacaagcataaaataagggatacaggcaaaaaatcatttaaatgcatagagtatggaaagaccttcaaccagtctagtaccaggacaacctacaaaaagatagatgctggagaaaaacggtataagtgtgaggagtgcggtaaagcttataagcagtcgagccatctgacaacccataagaagatccacactggcgagaagccatacaaatgcgaagagtgcggaaaagcctacaaacagagttgcaacttgaccacacataaaattatccatacaggtgagaagccatatcggtgccgggaatgcggaaaggcctttaatcacccagctacgctcttctcccataagaaaattcatacaggcgagaaaccctataaatgtgacaagtgtggtaaggctttcataagctcgtcaacactgacaaagcacgagatcatccatactggagagaagccgtataaatgcgaggagtgcggaaaggctttcaacaggagcagtaatttaacaaagcacaaaaggattcataccggggacgtgccttataagtgcgacgagtgcggcaaaacatttacgtggtatagctcacttagcaagcataagcgcgctcataccggggaaaagccttataagtgtgaggagtgcggcaaagcattcacagcattcagcaccctgaccgaacataaaatcattcataccggggagaagccgtacaaatgcgaagaatgtggcaaggcatttaattggtcttccgcgctaaataagcataaaaagatacacatccgccagaaaccatgtattgtgaaaaacgttgagaatctgctcaacgtgcctcagccactcatttctattaggtag

SEQ ID NO: 25406 - DNA, 1335 bp, Artificial Sequence
  Description of Artificial Sequence: Synthetic coding sequence
atggggcctctgcaattccgtgacgttgccattgagtttagcctggaagagtggcattgcctggatgcagcccagcgaaacctgtacagggatgtgatgttggaaaactatcgaaatctgatctttttggggatcgtggtctcaaaacccaatctaatcacgtgtcttgagcaagggaagaagcctttgacaatgaagcgacacgagatgatcgctaagcctcctgtcatgtacagccatttcgcacaagatctttggtctgagcagtctatcaaggatagcttccagaaagttattcttcgcaggtatgagaagtgtcgccacgacaatctacagttgaaaaaggggtgcgagtccgttgacgaatgccccgttcacaagcgaggttacaatgggctgaaacagtgcctcgcaacaactcagcgcaaaatcttccaatgcgacgagtacgttaaatttcttcataagttcagcaacagcaacaaacacaagatccgagacaccggaaaaaagagtttcaagtgtatcgagtacggtaagacctttaatcaatcctcaactcgcacgacatataaaaagatcgacgcaggtgagaagaggtataaatgcgaggaatgtggcaaagcttataagcagtcttcccaccttacgacccataagaaaatccacactggagaaaaaccatacaagtgtgaagagtgtggcaaggcctacaaacagtcttgcaacctgacaacgcacaaaattatacacaccggggagaagccttacagatgtcgtgaatgtggcaaagcttttaatcacccagcaacactgtttagtcacaagaaaatccataccggggagaagccatacaaatgtgacaagtgcgggaaggcctttattagttcctccaccttaaccaagcacgagatcatacatacaggagaaaagccctacaagtgcgaggagtgcggcaaggcctttaaccgatcctccaatctgactaaacataagcgcattcatactggcgacgtcccttataagtgcgatgaatgcggtaagactttcacttggtacagttctctgtctaagcataagcgcgcacatacaggcgagaaaccatataaatgtgaagagtgcggcaaagctttcactgcattctcgactcttactgagcataaaattatacacacaggtgaaaagccttacaaatgcgaggaatgtggaaaggccttcaattggtctagcgcacttaataagcacaaaaaaattcatatccgccagaagccttgcatcgtcaagaacgttgagaacctgctcaatgtgccccaaccgttgatttccatccggtag

SEQ ID NO: 25407 - DNA, 237 bp, Artificial Sequence
  Description of Artificial Sequence: Synthetic coding sequence
atgggacctctacagtttcgggatgtggcaattgagttttctctagaggagtggcattgtctcgatgccgctcagcggaacctgtatcgagatgtgatgttggagaactatcgcaacttgatcttcttaggcattgtggtgagtaaacccaatttaataacctgcctagaacagggaaaaaaaccactgacgatgaagaggcatgagatgatagcaaagcctccaggcggtctctag

SEQ ID NO: 25408 - DNA, 2862 bp, Artificial Sequence
  Description of Artificial Sequence: Synthetic coding sequence
atggaggaatcctcctcagtggcaatgctcgtgcctgacatcggcgagcaggaagctatactcacggccgagagcatcataagcccttcgctggaaatagacgaacagcgaaaaacaaagcccgatcccttgatccacgttattcagaagctcagcaagattgtggagaacgaaaagagtcaaaaatgcctgttgattggtaagaagagacctcgaagctccgctgccacacattctctggaaacgcaggagctctgcgaaattcccgcaaaggtgatccagagcccagccgctgataccaggagagccgaaatgtcccagaccaatttcactccggacactcttgcccaaaacgagggaaaagctatgtcctatcaatgttccctgtgcaagttcctctcctccagttttagcgtgttgaaagaccatatcaagcagcatggccagcaaaacgaggtcatccttatgtgtagtgagtgccacatcacatcaaggtcccaggaggagctcgaggcacacgtggtgaacgatcatgataatgatgcaaacatacacacccagtccaaagctcagcagtgcgtctctccctccagtagcctgtgccgcaaaaccacagagaggaacgaaactattcctgatattccggtgagcgtcgataaccttcaaacccacaccgtccaaacagccagcgtagccgaaatgggtaggagaaagtggtacgcctatgagcagtacggaatgtaccgctgcttgttttgctcttatacctgtggtcagcagagaatgttaaagacacacgcttggaaacacgctggggaagttgattgctcgtaccccatattcgaaaatgaaaacgaaccactcgggctgctggattcttcggctgccgcagccccaggtggcgttgatgccgttgtgatcgccattggagagagcgaattgagcattcacaatggaccgtccgtacaagttcagatctgctccagcgaacagctatccagcagctcgccccttgagcagtccgccgaaagaggagtccacctctcccagtcagtgacactggatccgaatgaggaggaaatgctggaggtcatatccgatgccgaggagaacctcatcccagacagcctcctgacctccgcccaaaaaattatttcctcaagtcccaacaaaaaaggtcatgtgaacgtgatcgtagaaagactgccaagcgccgaggagacactgtcccagaaacgcttcctgatgaacacagagatggaggagggcaaagatctctccctgaccgaggcccagataggtagagaggggatggatgacgtgtacagggctgataagtgtaccgttgatatcgggggactaattattggttggagcagttccgagaaaaaagatgagctgatgaacaaggggctggccaccgatgagaatgctccgcctggtcgacgtcggaccaattctgaatccctgcgactacatagcctcgctgccgaggccctcgtaaccatgccaattagggccgcagagctgaccagggctaacctgggacactatggagatatcaatctcctggacccggatacgagccagcgccaggtagactccactctcgcagcctattctaagatgatgtctcctctcaagaattctagtgacggactgacatccttaaaccagtctaactccacactcgtcgcgctgcccgagggccgacaagaactgtctgatggccaggtcaaaactggcatcagtatgagtctcctgacagtgatagagaaattgcgggagagaaccgaccaaaacgcttcagacgatgatatactgaaagagctgcaggacaatgcccagtgccagcctaattccgatacttccctgtccggtaataacgttgttgaatatattcctaatgctgaacggccataccgctgccgcctttgccactacacatcaggcaataaaggatatatcaaacagcatctaagagtgcacaggcagaggcagccatatcagtgccccatctgcgagcacatcgccgacaactccaaggacctagagagtcacatgatccatcattgtaaaaccaggatttatcagtgtaagcagtgcgaagagtcctttcactacaagtcccagctgcgtaaccatgaacgtgaacaacatagcttgcccgacaccttgagcatcgccacaagtaatgaaccgcgtatttcgagcgataccgccgacggtaaatgcgtgcaagagggaaacaaatcaagcgtgcagaagcaatatcgttgcgacgtctgcgattatacaagtaccacttacgttggagttaggaatcatcgaaggatccataacagcgataaaccctaccggtgttccctatgtggatacgtgtgtagtcatccaccctcattaaagtcccatatgtggaaacacgcctccgaccagaactacaactacgaacaagtgaacaaggctattaatgatgcaattagtcaatccggtagagtcctgggcaaatcacccggaaagacacagctgaaaagttctgaagaaagtgcagatcctgtcacggggtccagtgagaatgcagtctcctcgagcgaactcatgagtcagactccctcagaagttctcggcacaaatgagaatgaaaagctctctccaacatctaacacttcttactccctggagaaaattagcagcctagcccctccaagtatggaatattgcgtgctcctattctgctgttgtatatgcgggttcgagagcacatctaaagaaaacctgctggatcacatgaaggagcatgagggggaaatcgtgaatattatcctgaataaagatcataacaccgccctcaatacaaactag

SEQ ID NO: 25409 - DNA, 2862 bp, Artificial Sequence
  Description of Artificial Sequence: Synthetic coding sequence
atggaggaatccagcagtgtcgctatgcttgtgccggatatcggagagcaagaagccatcctaactgcagaatccatcatttctccttcacttgagatagatgagcagcggaaaacgaaaccggatcctctgatccacgtaatccagaagctgtctaagatcgtagaaaacgaaaagagccagaagtgccttctcataggtaagaagcgacccagatccagcgccgctacacattcactggagacacaagagctctgcgaaattcccgctaaggtgatccaaagtccagcggctgataccagacgggcagagatgagtcagactaatttcacgcctgacactttggcgcagaatgagggaaaggcaatgagctaccagtgttctctgtgcaagtttctctcaagctcgttcagtgttttaaaggaccacattaagcagcatggccagcagaacgaggtgatactgatgtgtagcgaatgccacatcactagccgcagccaggaagagctggaagcccatgtggtaaatgaccatgataatgacgccaatatccacactcagagtaaggcacagcagtgcgtatccccttcctcgagcttatgtcgcaaaacaacagagcgtaacgaaacaatcccggatatccccgtgtccgtggataacctccagacccacacagtgcagactgcatccgttgccgaaatggggaggcgcaaatggtatgcatatgaacagtacggtatgtacaggtgtctcttttgttcctatacttgcgggcagcagcgcatgctcaagacccacgcatggaagcacgccggtgaagtggactgctcttatccaatcttcgagaacgagaatgaaccgcttggccttctggacagcagcgcagccgctgcgccagggggagtggatgcggttgtaatcgccattggagagagcgagctgtccattcataatggcccttcagtccaggtccaaatttgcagcagtgagcagctttcttcctcctcccccctggaacagtcagctgaacggggagtgcatctgagccaatccgtaacattggatcctaacgaggaagagatgctagaggtcatctccgatgcagaggagaacctcatccctgattcactgctcacgtctgcccagaaaattatctcttcttcacccaacaagaaaggacacgtgaatgtcattgtggaaagactgccttccgccgaggaaactctgagccagaagagattcctgatgaacaccgagatggaggaaggcaaagacctgagtctaactgaggctcaaatcgggagggagggcatggacgacgtgtacagggccgacaagtgcaccgtggacataggcggattgatcattgggtggtcctcaagtgagaagaaagacgaactgatgaataagggacttgctacggatgagaacgcaccgccaggacgcaggagaaccaattcggagagcctgcgcctgcactccttggcagcggaagctcttgtgaccatgcctatccgagccgctgaattgacgcgagccaacttggggcactatggggacatcaatctgctagatcccgatacgtctcaacggcaggtggatagcacgctggccgcatattcaaagatgatgtcccctttgaagaactctagtgatggcctgaccagcctcaatcaaagcaattctacactggttgctctcccggaagggagacaggaactttctgatggtcaggtgaagacgggtatctccatgagcctactgacggtgatcgaaaagttacgggagcgaacagaccagaacgcttccgatgatgacattttaaaagagctccaggataatgcacagtgtcagcctaactccgataccagcctctctggcaataatgtggtcgagtatattcctaatgctgagagaccctaccgttgcaggctgtgtcattacacaagtggtaacaagggatatatcaagcagcaccttagagtgcataggcagaggcagccctatcagtgccccatctgcgaacatattgctgacaatagtaaggacctcgagtctcatatgatacaccattgcaaaacaaggatttatcagtgcaaacagtgtgaggaaagctttcattataagtcccagctgagaaaccacgaacgcgaacagcattcattaccggacaccctgagtattgcgaccagcaacgagcccaggatatcttcagacacagccgacggaaaatgtgttcaggaagggaacaagagctcagttcagaaacagtaccgttgcgatgtgtgcgactacaccagcaccacctatgtaggtgttaggaatcatcgaaggatacacaacagtgataaaccctaccgctgttctctgtgcggctatgtttgtagccaccctccttccctgaaatctcacatgtggaaacacgcctctgatcagaactacaattacgagcaggtcaacaaagccatcaatgacgcaatttcccagtcaggtcgggtattaggtaaatctccagggaaaacacagctgaagagcagtgaagagtctgcagatccggtcacaggctcatccgagaatgcagtctcatcctccgaactgatgagtcagaccccgtctgaggtgctcgggaccaacgagaatgaaaaactctcccccacatcgaatacatcgtacagtctggagaaaatttcaagcctcgcccctccgagtatggagtactgcgtgctcctgttttgttgttgcatctgtggattcgagtctacttccaaggagaatctgctcgaccacatgaaggaacatgagggcgaaatagttaatatcatcctgaataaagatcacaacaccgctctgaacactaactag

SEQ ID NO: 25410 - DNA, 2874 bp, Artificial Sequence
  Description of Artificial Sequence: Synthetic coding sequence
atggaggagtcctcttcagtggcgatgctagttccagacataggagagcaagaggcgatcctcaccgctgaatcaatcatcagtccttctctggagattgacgagcaacggaaaacaaagcccgatccattaatacacgtgatacagaagctgtccaagatcgtggagaatgaaaagagccaaaaatgcctccttatcgggaagaagcggccacggagcagtgccgcaacccacagcctcgaaacccaggaactctgtgaaatcccagccaaggtaatccaatctcccgcagcagataccaggcgcgctgagatgtcacagaccaatttcactccagataccctcgcacagaatgagggaaaagccatgtcttatcagtgttcattgtgtaaattcttgagctcctcatttagcgtattgaaagatcatatcaaacaacatggtcaacaaaacgaagtcatactgatgtgtagtgaatgtcacataacaagtaggagccaagaagagctggaggcacacgtggtgaatgatcacgataacgatgcaaatattcacacccaaagtaaggcgcaacagtgcgtgtctccctccagttcgttgtgcaggaaaacaaccgaacgaaacgaaactatacccgatatccctgtttccgtggataacctccagacccatacagtgcagaccgcgagcgtggctgaaatgggcaggagaaagtggtatgcttacgaacaatatggaatgtatcgatgccttttctgttcctatacctgcggacagcagcgtatgcttaagactcacgcctggaaacacgccggagaggtcgattgctcatatccgatcttcgagaatgagaatgagcccctcggactactcgatagcagtgcagcagctgcaccaggaggagtcgacgcagttgtgatcgctatcggcgagtcagaactgtctattcacaacggccctagtgtgcaagtccagatctgttcctctgagcagctctcaagcagctcccccctggagcagtctgctgaacgcggagtccatctgagccagtcagttacactcgaccccaacgaagaggaaatgttagaagttatttcggatgccgaggagaacctgattcctgatagcctgctgaccagcgcccagaagatcatcagcagctccccaaacaagaagggccatgttaacgtgatcgtggaacgccttccatccgctgaggagaccttgagccagaaacgtttcctgatgaataccgaaatggaggagggtaaggacctgtcactgacagaagcccagatcggaagggaggggatggatgatgtgtaccgggctgataagtgcaccgtcgacattggaggtctcataataggatggagttcctccgaaaaaaaggacgaactgatgaacaagggtcttgccacggatgaaaatgcgccacctggtcgaaggcgcaccaattctgaaagccttaggctccactctctggctgctgaagcgctggtgaccatgcccatccgagcggcagaactaactagagcgaaccttggtcactacggcgatattaacttgctagatccagatacgagccaaagacaggttgactctactctggccgcatattctaagatgatgtctcctctgaagaatagctccgatgggctgacgtctcttaatcaatcaaactctacattagtagcacttccagagggccgacaagaactctcagatggacaggtgaaaactggcatatctatgtcgctcctgacggtcatcgaaaagctcagggagaggaccgaccagaatgcgtcagatgatgatatcctaaaggagctgcaggacaatgctcagtgccagccaaactccgatacctctctctccgggaataacgtcgtagagtacattcccaatgcagaacggccataccggtgcaggctatgtcactatacctccggaaacaaagggtatatcaagcaacacctgagggtacatcggcagagacagccctaccagtgccctatatgtgaacatattgccgataactcaaaggacctagaaagccacatgatccatcattgcaaaactcggatctaccagtgcaagcagtgcgaggaatccttccactataaaagtcagctgcggaatcatgaaagggaacagcatagcttgcctgacactttaagcatcgctacctccaacgaaccaaggatttcctccgacactgctgacggcaaatgcgtccaggaaggaaacaaaagctccgtgcagaagcagtacagatgtgacgtctgcgattacactagcactacctacgtgggggtcagaaaccaccggaggattcacaatagtgacaaaccttacaggaaggaattccgctgctcgctatgcggatacgtttgtagccatccaccatcactgaagagccacatgtggaagcacgcgagcgaccaaaactacaattatgagcaggtaaacaaagccatcaacgatgcaattagccagtctgggagggtgctgggcaagtctcccggtaaaactcagctgaaaagctccgaagaatcggcagaccccgtgaccggcagctcagaaaatgccgttagctcctccgaactcatgtcacaaactccaagcgaggtgctgggaacaaatgagaacgagaaactgtcgcccacatcaaatactagttacagcttagagaagatctcatctctggcgccaccctctatggaatactgcgttctgttgttctgctgttgtatctgcgggtttgaaagtacctcaaaagagaatctgttagatcatatgaaggagcacgaaggagagattgtgaatattatactgaataaagatcacaacacagccttaaacacgaactag

SEQ ID NO: 25411 - DNA, 1689 bp, Artificial Sequence
  Description of Artificial Sequence: Synthetic coding sequence
atgagtcgctccttgctcctctggttcctgctattcctgctcctgctgccaccgttgcctgtcctgcttgccgaccctggtgcccctactcccgtgaatccatgttgctattatccctgtcagcaccaggggatctgcgtgagatttggtctggaccgctaccagtgtgattgcacaaggaccggttatagcggccctaattgcaccatccctggcctctggacgtggctgaggaacagcctacgcccttctccttcttttacccactttctgcttacacacggtagatggttctgggaatttgttaatgctacctttattcgagagatgttgatgcgcctggtactcacagtgagatccaatctcatcccttccccacctacttataacagtgcacacgactatatatcttgggaaagcttcagtaatgtgtcctattatactcgcatcctcccgagcgtgccaaaggactgccccacgccaatgggcactaaaggcaaaaagcagctgcctgacgcccaactgcttgctcgcagatttctcttaaggcgaaagtttattcctgatccccaggggaccaatcttatgttcgctttctttgctcagcacttcacacatcagttttttaaaacctctggaaaaatgggacctggattcaccaaggcccttggccacggagtggacctggggcatatctatggcgacaacctggaacggcagtatcagctgaggttgttcaaggacgggaagctgaaataccaggtcttagacggcgaaatgtatcctccgtcagttgaagaggcaccagttctcatgcactatcctaggggtatcccaccacagagccaaatggccgtgggccaggaagtcttcggcctgctgccgggacttatgctctatgccaccctatggctccgtgagcacaatagggtgtgtgaccttttgaaagctgaacatcccacgtggggtgatgagcagttatttcagaccaccaggcttatcctgatcggggagaccatcaaaatagtgattgaggagtacgttcagcagctatcagggtactttctccagctgaaatttgaccccgagctgctgtttggcgtgcagtttcagtacaggaaccgcatcgccatggaatttaaccatctgtatcactggcacccattgatgccggacagttttaaaatcggcggtggcaggaatatggaccatcatatcctgcatgtggccgtagacgtgatccgagaatccagagagatgcgcctgcagccctttaatgaatatcgtaagcgatttggcatgaaaccatatacctcttttcaggagctggtgggagagaaagaaatggccgcagagctagaagaactctatggagatatcgacgccctggaattctaccccggactcctgctggagaaatgtcatcccaatagcattttcggggagagcatgattgagatcggagccccattcagtctgaagggtctgctgggtaaccccatctgcagccctgaatattggaaaccctcaaccttcggtggtgaagtgggctttaatattgtgaaaaccgcgacacttaaaaagctggtctgcctcaacaccaagacttgcccttatgtgtcttttcgcgtgcctgacgccagccaggatgacggcccagcggtggagcgacccagtactgaactctag

SEQ ID NO: 25412 - DNA, 405 bp, Artificial Sequence
  Description of Artificial Sequence: Synthetic coding sequence
atgtcccctcacccggaggctatcacggattgcgtaactctgaataccgtcggacagctggccgaagggggataccctctgagatttagtaccctatttcaggagcagcagaaaatgaatatctctcaggcatcagtgtcatttaaggacgtgaccatagagttcacgcaagaagagtggcagcagatggcccctgtgcagaagaacctctatcgcgatgttatgttagagaactattcaaatctggtctcggttgggtactgttgttttaagcctgaggtgatattcaagctggaacagggtgaagaaccctggttcagtgaagaggagttttctaaccagagccaccccagcgaactgttaagttcatcacgacataatagtgccggtgtcgtccggctatag

SEQ ID NO: 25413 - DNA, 2052 bp, Artificial Sequence
  Description of Artificial Sequence: Synthetic coding sequence
atgagccctcaccctgaggccatcacagattgtgtgacgcttaataccgtggggcagctcgcagaaggcggatatcccctcaggtttagcaccttattccaggaacagcaaaagatgaacatctcccaggccagcgtctcattcaaagatgttacaatcgaattcacccaagaggaatggcagcaaatggcacccgtccagaagaacctatatcgcgacgtcatgctggaaaactactcaaacctagtgtctgtggggtattgctgttttaaacctgaagtaatcttcaagcttgaacaaggagaggagccttggttctcagaggaggagttttccaaccagtctcacccaaaagattatagaggcgacgacctgattaagcagaacaagaagatcaaagataagcacttggagcaggccatctgtatcaacaacaagacacttactaccgaggaggaaaaggtacttggaaaaccgtttactctccatgtggctgcagtggccagtaccaagatgtcttgcaaatgtaatagctgggaagtgaacttgcagagtatttcagagttcattattaataaccgcaattattccacaaaaaaaatcggctgtggcaacgtctgtgaaaactctcctttcaagataaatttcgagaagactcagactggagagaagttttacgagcacaataagaacatgaaagccttgaattacaacgagaatctccccaagcatcctaagttccaaacacttgaacaagccttcgaatgtaacaaaatcggaaaggctttcaatgacaaggccaactgtgtgaagcacaactcaagtcatacaggtgaaacctcctccaaggacgacgagttccggaagaattgcgacaaaaaaactcttttcgaccaccgccgaaccggtacagggaagaagcacctccacttaaatcagtgtggcaagtcttttgagaaaagtactgtggaggagtataataagctgaacatggggatcaaacactatgagctgaacccatctggaaataactttaaccggaaagcacatctcaccgatcctcagactgcggtgattgaagagaaccccctcgtcagtaacgataggacccagacatgggtgaaatcaagcgagtatcatgagaataaaaaaagctaccagacctctgtgcacagagtgcgtagaagaagtcattcgatgatgaagccatacaaatgtaatgaatgtgggaagtctttttgtcagaagggccacctgatccagcatcagagaacccacacgggcgaaaagcccttcgaatgttccgaatgtggaaagaccttcagccagaagagccatttatctacccatcagcggatccacactgctgagaagccatataagtgcaatgaatgtgggaaaaccttcgttcagaagagtacactcaggggacatcaaagaatccacaccggcgagaagccatatgaatgctcagagtgcggcaaaacttttgtgcagaagagcactttaagagaccaccaccggatccatactggagagaaaagctttcaatgcaatcagtgcgggaaaacattcggtcagaaatccaatcttcgtatacaccaaagaactcacaccggagagaagacctatcagtgcaacgaatgcgaaaagtccttttggcggaaggaccacttgatccagcaccaaaagactcacaccggggagaagccttttaagtgtaacgaatgtggcaaaacattcgcgcgtacctccactctgcgcgtccaccagcgtatacatacgggcgaaaagcccttcaagtgcaatgagtgtgggaaaaaatttgtcagaaaggcaatcctaagcgaccatcaacggatccacactggagaaaaaccctttcagtgcaacaagtgtggcaaaacttttgggcagaagagcaatttgaggatccaccaaaggactcattcgggagaaaaaagctacgagtgtaatgagtatggcaagctctgcaagaagtcgacgctctcactgtaccaaaaaattcaaggagaaggcaacccctattag

SEQ ID NO: 25414 - DNA, 789 bp, Artificial Sequence
  Description of Artificial Sequence: Synthetic coding sequence
atgcagttgcctccggctctttgcgccaggttggcagccggaccaggggctgccgagcctttgcctgtcgaacgggatccagccgctggggcagcaccctttaggttcgtcgcccgtcctgtaaggttccccagggaacatcagttcttcgaggatggtgacgtccaaaggcatctctacctgcaggacgtcatcatgcaggtagctgacgtccctgagaaacctcgggtgccagccttcgcttgccaggtggcaggctgttgtcaagtattcgacgcattggatgactatgagcaccactatcacaccctgcatggcaacgtttgctccttttgtaaacgagcgttcccttccggccatttgttggatgcacacattctcgagtggcacgactcactgttccagatcctgtcagagaggcaggatatgtaccaatgcttagtggagggctgcactgaaaagtttaagaccagccgcgatcgaaaagatcatatggtacgaatgcacctctaccccgctgactttagatttgacaaacctaaaaaatcacgatctccagcctctgcagaggctcctggcgactcaggcgagagatcagagggagaggctatggaaatttgtagtgaacctgtggcagcgagccctgccccagccggagaacgcagaatctatcggcatcgcagcgtcagtgaactcttccttaaacccgtgcttaatatgtgttcggtgcttaggattctgggatgtacatgggccgctgccctgcttattctgaattcagaaagatag

SEQ ID NO: 25415 - DNA, 759 bp, Artificial Sequence
  Description of Artificial Sequence: Synthetic coding sequence
atgcagctcccacctgcactgtgcgccagactggcagcaggacctggggctgctgagcctctccctgtggaacgcgatcctgcagcaggagctgcacctttccgattcgtggctcggccagttcgatttcccagagaacaccaatttttcgaagacggggatgtccagaggcacttgtatctccaggatgttattatgcaagtggccgacgttccggagaagccgagagttccagcatttgcctgtcaggtggctgggtgctgccaggtgttcgatgctttggacgactacgagcaccattaccataccctacacggaaatgtctgtagtttctgtaagagggcttttccttctgggcatctgctggatgcccatatccttgagtggcatgattccttatttcagatcctcagtgagcgacaggatatgtatcagtgtctcgtcgagggctgtacggaaaagttcaagactagtagagatcgcaaggaccacatggtgcgcatgcacctctatcccgctgatttccggtttgacaagcctaaaaagagtaggagccccgcttctgccgaagcccctggcgactcgggcgagcgttcagagggcgaggcaatggaaatatgtagtgagcccgtggctgcttctcccgcaccggctggcgaacggaggatatacaggcaccgcattccttcaactatctgtttcgggcagggggctgcgcgaggttttaaaagcaacaaaaaaaaaaccaaacagtgttag

SEQ ID NO: 25416 - DNA, 933 bp, Artificial Sequence
  Description of Artificial Sequence: Synthetic coding sequence
atgcaggtggccgacgtccctgagaagccccgtgtcccggcttttgcatgccaagtggccggttgttgccaagtgtttgatgccctggatgattacgaacatcattaccacaccctccatggcaatgtatgttccttttgtaaacgtgccttcccgagtggccacctgctagacgctcacatcttggagtggcatgatagtctgttccagattcttagcgaacgtcaggacatgtaccagtgtctagtggaaggctgcactgagaaatttaagacttccagggacaggaaggaccatatggtgagaatgcacttgtacccggctgattttaggttcgataaacctaaaaaatcccgctcacctgcttcggctgaagcccctggcgactcaggagaaaggtccgaaggtgaggcaatggagatctgtagcgaacctgtggctgccagtccggctcccgcaggagagcggaggatctatagacataggctgcttctggttacaagccttgtggtagttttgttgtgggaggcaggggcagtgccggcaccgaaggtgcccattaaaatgcaggtcaaacattggcccagcgaacaggatcccgaaaaagcctggggcgcacgcgttgtagagccacctgagaaggatgaccagctggtggtacttttcccagttcagaagccaaagttgctcacaactgaagagaagccaagaggccagggcagggggccaatactacccggaacaaaagcctggatggagacagaggatacattgggacacgtcttgagccccgagccagatcacgactctttgtaccatcctcccccagaagaagatcaaggagaggagaggcctaggctgtgggttatgccgaatcaccaggtcctgctaggtccagaggaagatcaggatcatatataccatcctcagtag

SEQ ID NO: 25417 - DNA, 1704 bp, Artificial Sequence
  Description of Artificial Sequence: Synthetic coding sequence
atgtcaagtagactgggagccgttcccgctacctcagggcctaccacttttaaacagcagaggagcactcggatagttggtgccaagaactcacgaacacagtgtagtattaaggacaatagtttccagtacacaataccacatgacgatagtctgtctggaagcagctccgcatcaagttgtgagcctgtctccgatttccctgcctcgtttaggaagagcacatactggatgaaaatgagaagaataaagcccgcagccaccagccacgtagaagggtctggcggtgtgagcgccaaaggcaagcgtaaacccaggcaggaagaggatgaggattatcgcgagttcccccagaagaagcacaaattatatggaaggaaacagcgccctaaaactcagcctaaccccaagtcccaagcgaggagaattcggaaagagcctcccgtctatgccgctgggagtctggaagagcagtggtacctggaaatcgtcgacaaagggtctgtgagttgtcccacttgtcaggctgtagggaggaagactatcgaggggttgaagaagcacatggaaaactgcaagcaagaaatgttcacttgccatcactgtggcaaacagctgaggtccctcgctggtatgaagtaccatgtcatggccaaccacaattctctgcctatcctcaaggccggtgatgagattgatgagccgagtgaacgtgagaggcttaggaccgtccttaagcggttgggtaaactgaggtgtatgagggagtcttgctcctccagttttacaagcatcatgggttacctataccatgtcagaaaatgcggaaagggcgctgccgagctggagaagatgacgttgaagtgccaccattgcggcaagccttaccgtagtaaagcaggcttggcctaccatctgaggtccgagcatggccctatatccttcttcccagagtcgggccagccagaatgtctcaaagagatgaacctagaatccaaatctggaggcagagtgcagcgaaggtcggctaaaatcgccgtctatcacctgcaggagctggcaagcgctgaattagctaaagagtggccaaagcgcaaggtcctgcaggatctcgtacccgatgaccgcaagctgaaatacactagacccggtctgcccacctttagccaggaggtacttcacaaatggaagactgatattaaaaagtatcatcgtatccagtgtccgaatcagggctgcgaggccgtctacagctctgtgtctggactcaaggcccatctgggatcgtgcactcttggaaacttcgtcgcaggtaagtacaagtgcctactctgtcagaaagagtttgttagtgaaagcggagtcaaataccacatcaattcagtgcacgctgaggactggtttgtcgttaaccccacaacaactaagagttttgagaaactgatgaagatcaagcagcgccagcaagaggaggagaagcgccgtcagcagcaccgctcccgcagatcgctgcgtaggaggcagcagcccggtattgagctccccgagactgagctttccttgcgcgtgggaaaagatcagcgacggaacaacgaggagcttgttgtgtcggcttcctgtaaggagccggaacaggagcccgttccagcacagtttcagaaagtgaaacccccaaaaacaaaccacaagagaggaagaaaatag

SEQ ID NO: 25418 - DNA, 1701 bp, Artificial Sequence
  Description of Artificial Sequence: Synthetic coding sequence
atgagctctcggcttggggcagttcccgctacctccggtcccaccacctttaagcagcagcggtcaacaagaattgtcggagccaaaaaccgcactcagtgttctattaaagataactcctttcagtatacaatccctcacgatgattcattatccgggtctagttccgcaagctcatgtgaacccgtatctgattttcccgcttcctttcgcaagagtacctactggatgaagatgagaaggattaaacccgctgcaacatcccatgtcgaagggagcgggggagtgtctgccaagggtaaacgcaagcctcgacaggaggaggatgaagattacagggagttccctcagaaaaaacacaagctatatggtcgcaaacagaggccaaagactcaacccaaccccaagtcccaggcacggaggataaggaaagagcctccagtctacgccgcaggaagcctcgaagagcagtggtatctggaaatcgtcgataagggctctgtttcctgtccgacctgccaggctgtcggccgtaaaaccatcgagggccttaaaaaacacatggagaactgcaagcaggaaatgttcacctgccaccattgcgggaagcagcttcgaagcctggccggaatgaagtaccatgtgatggctaatcacaacagcttgcctatcttgaaagcaggcgacgagatcgacgaaccgtccgagagagaaagactaagaaccgtgcttaaacgactgggaaagctgagatgtatgcgggaatcctgctcttcctctttcaccagcattatggggtatctgtatcacgttagaaaatgtggtaagggcgctgcggaactggagaagatgactctaaaatgtcaccactgcggcaagccctatcgctctaaagcagggctggcctaccatctgcgctcagagcacgggccaatcagctttttcccagagagtggccagccagagtgccttaaagagatgaaccttgagtctaaaagcggcggtagggtgcagaggaggtcagcgaaaatagcggtgtatcacctccaggagctcgccagtgcggaacttgccaaagagtggccaaaacgcaaggtgttacaagatcttgtgcccgatgataggaaattaaagtatactcggcctggtctgcccaccttttcacaggaggtccttcataaatggaaaaccgatataaaaaagtatcataggattcagtgccctaaccaaggctgcgaagctgtctactcgtccgtgtcgggacttaaagcccatttgggaagttgcacgttaggtaactttgtggctggaaaatacaagtgtctgctttgtcagaaggagttcgtttcagagtcgggcgtgaagtatcacattaacagcgtgcacgcggaagattggtttgtggtgaacccgaccaccacgaagtcgttcgaaaaattgatgaaaattaaacaacggcagcaggaggaggaaaagcggaggcagcagcaccgctctcgaaggtcattgaggcggcgacaacaacccggtatcgagctccccgaaacagaacttagtttacgggtgggaaaggatcagcgcagaaataatgaggagctggtggtctctgcttcctgcaaggaacccgagcaggaaccggtcccagcccagttccagaaggttaaaccgccaaaaaccaatcacaagagagggcgtaagtag

SEQ ID NO: 25419 - DNA, 1473 bp, Artificial Sequence
  Description of Artificial Sequence: Synthetic coding sequence
atgaagatgaggcggattaagcctgctgccacctcacacgtggaaggaagcgggggtgtgtccgcaaagggcaagcggaagccgagacaggaggaggacgaggattatagagagtttccccagaaaaagcacaagctctatggaaggaagcaaaggccaaagacccaacccaaccctaagagtcaagcacggagaatcagaaaggaacctccagtctacgccgctggttctctggaggagcaatggtacttggaaatcgtcgacaaaggcagcgtgtcctgccccacctgccaggctgtggggaggaagacaatcgaaggtctgaagaaacacatggagaactgtaaacaggaaatgttcacctgccatcactgcggcaaacagctcaggagtctcgcgggaatgaaatatcatgtaatggcaaaccacaatagcctgcctattctcaaagctggggatgagattgacgagccatctgagagggagcgcctcaggacagtgttgaagcgactcggcaagctgcgatgtatgcgcgagtcctgcagctcaagctttacttccattatgggttacctctaccatgtgaggaaatgtggaaagggcgctgccgagctcgagaaaatgactctcaagtgtcaccactgcggaaagccttataggagtaaagcagggcttgcgtaccatctgcgctccgagcacgggcctatcagctttttcccggagtcagggcagccagaatgcctgaaggagatgaacctggaatccaaatcaggaggcagagtccagcggaggagcgccaaaatcgcagtctaccacctgcaagaactggctagcgctgagctggcaaaagagtggccaaagagaaaggtgttgcaagatctggttcccgatgaccggaaactgaaatacacacggccaggtctccctacgttttcccaggaggtattacacaaatggaagaccgatatcaagaagtatcacaggatacagtgtcctaatcaggggtgcgaagctgtttatagctcagtaagtggacttaaggctcacctgggctcttgcacgctggggaactttgtggctggcaagtataagtgtttactgtgtcagaaagagttcgtctccgaaagcggtgtcaaatatcacattaactccgttcacgccgaagattggtttgtcgtgaacccaactactactaagagctttgagaaactcatgaaaatcaagcaacgccagcaagaggaagaaaagaggcggcagcaacatcgtagccggcgttcattgcgaagaagacagcagcctggcattgagctgccagagacggagctttcactgagagtcggaaaagatcaaagaaggaataatgaggaacttgttgtgtcagcttcttgcaaagaacccgagcaggaaccagtccccgctcagtttcagaaagtcaaaccacctaagaccaaccacaaaaggggccgaaaatag

SEQ ID NO: 25420 - DNA, 1617 bp, Artificial Sequence
  Description of Artificial Sequence: Synthetic coding sequence
atgagctcccgcctgggcgctgtgcccgcaacatccgggccaacaacctttaaacagcagagatccacgaggatcgtcggggctaagaaccgcactcagtgctctatcaaagataacagcttccagtacaccatacctcacgatgattccctgtctggctcctcaagtgcctccagctgcgagcctgtatctgattttccagctagttttcgaaagtccacctattggatgaaaatgagaaggattaaaccagccgctaccagccatgttgaaggctccggcggagtaagtgccaagggaaagaggaaaccacgacaggaagaggacgaggattatcgggagttcccccaaaagaaacataagctctatggctccctcgaggagcagtggtatttggaaatcgttgataaggggtcggtgtcatgccccacatgtcaggcggtgggtcggaagacgattgaaggactaaagaaacatatggaaaactgtaagcaggagatgttcacttgccaccattgcggaaagcagctacgatccttggccggaatgaagtaccatgtgatggcaaaccataattctctccccatccttaaggccggtgacgaaatagacgagccttctgagcgcgagcggctgagaacggtgctgaagcgactcggaaagctgcgctgcatgagggagagttgttccagttcattcacgtcaatcatgggctacctgtaccatgttagaaaatgcgggaagggggcagcagagctcgaaaagatgacgctaaaatgccaccattgtgggaagccttacaggagcaaggccggactagcatatcacctgcgttctgaacacgggccaatttcttttttccctgagagtgggcagccagaatgtctgaaggagatgaatttagaatcaaagtcaggcggaagagttcaaaggagaagtgcaaagatagccgtttatcacctccaggagctggcatctgctgaactcgctaaagagtggcccaagagaaaagtgttgcaggacctggtacctgatgaccggaagcttaaatacacgcggccaggcttaccaacattcagtcaggaagttctgcacaaatggaagacagacataaagaagtaccacagaatacaatgccccaatcagggctgcgaggccgtgtattctagcgtctcaggactgaaggcacatttgggctcttgtacacttgggaatttcgtcgccggaaagtacaagtgcctcttgtgccagaaagaattcgtgtccgaatcaggcgtgaagtatcacattaactccgtgcatgctgaagactggttcgtcgtaaatcctacaacgacgaaatctttcgagaagctgatgaagattaaacagcgccaacaggaggaggagaaaaggaggcaacagcaccggtcaagacgttccctccgaaggcggcaacaaccagggattgaactacctgaaaccgaactcagtctgagagtgggaaaagatcagcgccgaaacaacgaagagctcgttgtcagcgcctcctgcaaggaacctgagcaggagcccgtccctgcgcagttccaaaaggtaaagcctcctaagacaaaccacaaacggggacggaagtag

SEQ ID NO: 25421 - DNA, 1158 bp, Artificial Sequence
  Description of Artificial Sequence: Synthetic coding sequence
atgtccaaggggcaggttgagtaccagcccagggggaaagggaacccaggccgaaaaaaaatgaagacgatcgaaaactttttgcggaggtccattagcttcatgggcggatccaatggactcaaattgtctccaattcccaatcctcggcctgtcgtcttcggcaggaaccaccagttcatgcagcaggaaatgtttacctgtcaccattgcgggaaacagttgagatcactggcgggtatgaagtaccacgtgatggctaaccacaatagcctgccgatcctcaaggctggagatgagatcgacgagccttcagaacgggagcgtctgaggacagttttgaaaagacttggaaagttacgctgcatgcgggagtcgtgttccagcagcttcaccagcattatgggttatctgtaccatgtgcgcaaatgcgggaagggggctgcggagctagaaaagatgaccctaaaatgccaccactgcggaaagccttaccgcagtaaggcagggctagcctatcatctccggagcgaacacggcccaatttctttcttccctgaatcaggccagcctgagtgtctgaaagagatgaatctcgaatccaaatccggcggaagagttcaacgaaggtcggctaagatcgccgtgtaccatctgcaggagctggcttccgccgagctggccaaggaatggcccaagcggaaggtcctccaggatctggtccctgatgaccgcaaactaaagtatacacgccctggtttgcccacattctctcaagaagttctgcataagtggaaaacagacattaagaagtaccaccggatccagtgtcccaatcaaggttgtgaagccgtatatagctcagtgagcgggctcaaggctcatctggggagttgcactttggggaacttcgttgcaggaaaatacaagtgcctcttatgccagaaggagttcgtgtcagagtctggcgtaaagtaccacatcaattccgtgcacgcagaagattggttcgtggttaacccaaccacaaccaagagcttcgaaaagttaatgaagatcaagcaaaggcaacaggaagaagaaaagcgaaggcagcagcatagaagtcgccgaggttcacaggatacatgtatgcctaaagcccttcaccggatgtag

SEQ ID NO: 25422 - DNA, 690 bp, Artificial Sequence
  Description of Artificial Sequence: Synthetic coding sequence
atggactcagccggtcaggacatcaacctgaatagcccaaacaagggtcttctcagtgactccatgacagacgttcctgtcgacacaggcgtcgccgcacgtacaccagccgtggaggggctgactgaggccgaggaggaagagctacgagccgagttgacaaaggtcgaggaggaaatcgttaccctccgacaagttctggccgcaaaggagcgccactgtggtgaactgaagagacgcctcgggctgtccacactgggagagctgaaacagaacctgtcccgcagctggcatgacgttcaggtgagttcagcgtacgtaaagacaagcgagaagctgggggagtggaacgagaaagtgacacaatcagacttgtataaaaaaactcaggaaaccctatcccaggctggacaaaaaacctctgctgctctatccaccgtgggcagcgccatttcacgcaaactgggcgacatgcgagctcatcccttcagccattcattctctagttattccatccgccatagtatcagtatgcccgcaatgcgaaacagcgccacattcaaatctttcgaggatcgggtgggaactatcaaaagtaaggtggttggagatcgcgaaaatggctcagataaccttccatcttccgcaggaagcggcgacaagcctttaagcgaccctgctcccttctag

SEQ ID NO: 25423 - DNA, 2679 bp, Artificial Sequence
  Description of Artificial Sequence: Synthetic coding sequence
atgacagacccattctgcgtgggtggtcgacggctcccaggctctagtaaatcgggtcccggtaaggacgggagcagaaaggaggtgcgcctgccaatgcttcatgaccctccgaagatgggcatgccagtggttcggggtggtcagaccgtgcctggacaggctcctctctgcttcgaccccggatcccccgctagtgataaaactgaaggtaagaagaaggggaggcccaaggccgagaaccaagctctacgcgacattcctctcagtctgatgaatgactggaaggatgagtttaaagcccattctagagtcaagtgtcctaacagcggctgctggttggagttccctagtatttacggcttgaagtaccattatcagaggtgccaaggcggtgcgatctccgatcggctggcttttccttgccctttttgcgaggcggctttcacatcaaaaacccagttggagaagcataggatatggaatcatatggaccgccctttgcctgcctcaaaacccggacctatcagtagacccgtgacaatcagtagacccgtgggcgtctcgaaacccatcggagtgtctaagcctgtcactatcgggaaaccagtcggcgtttccaaaccaattggaatttccaagccagtcagtgtgggaagacccatgcctgtgaccaaggctattcccgtgactcggccagtgcccgtcactaagccggtcaccgtatctcggccaatgcctgtgaccaaggccatgcccgtaacaaaacccattacagtgacgaagagcgtgcccgtcaccaagcctgtgcccgtcacaaaacccattaccgttacaaaactggtaactgtgaccaagccggtgcccgttactaaaccagtaaccgtttcaagaccaattgtggtctcaaagcctgttaccgtttcccgccctattgccatttcgcggcatactccaccttgcaaaatggtgctgttaacccggtccgagaacaaagcgcctcgcgctaccggaaggaacagcggtaaaaaacgggctgccgattctctcgatacctgtcccatccctccgaaacaagcacggccagagaatggggagtatggcccatcgtccatgggccagagctccgcattccaacttagtgcagatacttccagtgggtccctcagtccaggttcacggccttccggcggtatggaggcactgaaagctgccggtccagcttctcccccagaagaagatcccgaaagaactaagcatcggcgtaagcagaaaacacctaaaaagtttacaggagagcagccctcaatcagtgggacgttcggtctgaagggcttagtcaaggccgaggacaaggcacgtgtacaccggtctaaaaaacaggaggggcctgggccagaggacgcaaggaaaaaagttccagccgctccaattaccgtctctaaggaagctccagccccagtggctcacccagcccctgggggacccgaagaacaatggcagcgcgcaatccacgagaggggggaagcggtctgccctacttgcaatgtggtcactcgcaaaacactggtgggacttaagaagcacatggaagtttgtcaaaagcttcaggatgccctgaagtgccagcattgccggaaacagtttaagagcaaggctgggctgaactatcatacaatggcagaacattccgccaaaccttccgatgcggaagcctccgaaggcggagagcaggaggagagggaaaggctgaggaaggtactcaaacagatgggccgattgcgctgtcctcaggagggctgtggcgcagctttctcctcactgatgggttaccagtatcaccaaaggaggtgtgggaagccgccttgcgaagtggatagcccatcctttccatgtacacactgtggaaagacttaccgttccaaagcagggcacgattatcatgtccggtctgaacatactgcgcctccccctgaggagcctaccgataaatcccctgaggcagaggatcccctgggtgttgagaggaccccatctggcagagtgcgtcgaacatcagcccaggtcgcagtcttccacctccaggagatcgccgaggacgagcttgccagggactggaccaagcggaggatgaaagatgatctagtaccggagacggcccgactaaattatacccgcccaggactgccgacattgaaccctcagctgctggaggcgtggaagaacgaggtaaaagagaaaggccacgtgaactgccctaatgactgttgtgaggccatttactcctctgtttctggcctgaaagcccatctggcttcctgttccaagggggcacacttagccggaaagtacaggtgtctcttatgtccaaaggaattcagtagcgaatccggagtgaagtaccatatactgaagacccacgctgagaattggtttcggacctccgcggatcctcctccaaagcatagatcacaggattccctagtgcccaaaaaagagaagaaaaaaaatctggcagggggtaagaaaaggggaagaaaacccaaggagaggacccccgaagagcctgtagcgaaactcccgcctcgccgagatgattggcctcccggttgtcgtgataagggtgcacgaggctccacaggcagaaaggtgggcgtctcaaaggcccctgagaagtag

SEQ ID NO: 25424 - DNA, 2679 bp, Artificial Sequence
  Description of Artificial Sequence: Synthetic coding sequence
atgaccgaccccttttgtgtggggggacgcagactcccgggatcatccaaaagcggacccggaaaggatggatcaagaaaagaggtgcgccttccaatgctgcacgatccccctaaaatgggcatgcctgttgtgcggggaggccagaccgtgcctggacaggcacctctctgcttcgaccctggcagcccagcttcggataaaacagaaggaaaaaaaaagggaagaccgaaggcggagaaccaagccctacgggacatccccctttctttgatgaatgattggaaggacgagttcaaagctcactccagggtgaagtgtccgaacagtggctgttggctggagtttccttccatatatggactcaaataccactaccagaggtgccagggcggtgccattagtgataggttagcctttccctgcccattctgcgaggccgcttttacttcaaagacacagctggaaaaacacaggatctggaatcacatggatcgacctctgcctgcctccaagcctggccctatctccaggccggtgacaatttctcgtcccgtaggcgtttccaaacctataggagtgagtaagcctgtgactattggcaagcccgtgggggtaagtaaacctatcgggatttctaagcccgtgagcgtgggtcgacctatgcctgtcactaaagcaataccggttaccagaccagtacccgtgacaaagcctgtaacggtttcccgtccaatgccagtcactaaggccatgcccgtgactaaaccaatcaccgtgacgaagagtgtccccgtgaccaagccagtgcccgttacaaaaccaattaccgtgacgaagctggtcacagtgacaaaacccgtccccgtcaccaagcctgtcacagttagtaggcccattgtagtgtccaagccagtgactgtatctagacctattgcaatatcgagacacacgcctccctgtaagatggtcttgctaacacgctcagagaacaaagcacccagggctacgggcaggaactcaggaaaaaaacgggctgctgacagtctggacacatgtccgatccctcctaagcaggcaaggcccgagaacggagaatacggaccaagctcgatggggcagtccagtgcgtttcagctctcagctgatactagctcaggttctctctcacctggaagcagacccagcgggggaatggaagctctgaaggccgctggtcccgcaagcccacccgaggaagaccctgagagaactaagcatcggcgtaaacaaaaaactccaaagaaattcaccggagaacagccaagcatctccggtactttcggactgaagggcctggtgaaggcagaagataaggcgcgtgttcaccgatctaagaagcaggaaggcccaggacccgaggatgctagaaaaaaggtccccgcagcccctatcaccgtctctaaggaagccccagcacccgttgcccacccagctccgggaggaccagaagagcagtggcaacgtgcaatacacgaaagaggggaggctgtttgccccacctgtaatgtagttactcgcaagactttagttggtctaaaaaaacatatggaagtttgccaaaagctgcaagatgccctgaaatgccagcactgcaggaaacagtttaagagcaaagcaggtctgaactatcatacaatggctgagcactcggcaaaacccagtgatgcggaggccagtgaagggggagagcaggaggagagggagagacttcggaaggtactgaaacagatgggcaggctgcggtgcccacaagagggatgcggcgctgcattctctagtttgatggggtatcaatatcatcagcgtagatgtggtaaacccccttgcgaggtggacagccccagctttccctgtactcattgtgggaaaacctaccgctccaaggccggacacgattaccacgtgaggtcagagcataccgccccaccccctgaagaaccaacagacaaaagccctgaagccgaagacccactgggcgtggagcgtactcccagcggacgtgtgagacgaacatctgcccaggtggctgtcttccatctgcaggagatcgctgaggacgagttagccagagattggaccaaacgcagaatgaaggatgacttggtgcccgagactgccagacttaattatacaagacctggactgccaaccctcaacccccagctgttagaggcctggaagaatgaagtgaaagaaaaaggtcatgtcaattgtccaaatgattgttgtgaagccatatactcctctgtaagcggcctgaaggcacacctcgcttcatgttctaaaggagctcacctcgcgggaaagtatcgatgtctgctgtgtcctaaggaattttcctctgagagcggcgttaagtatcatattttgaaaacacatgccgagaattggttcagaacaagcgccgatcctccacccaagcacaggagccaagattctctggttcccaaaaaagaaaagaagaagaacctcgctggcggaaaaaagaggggtcggaagcccaaagaacggacacccgaagagcctgtagcaaagctcccccctcgccgtgacgattggcccccaggctgtcgtgacaaaggcgctcgcggatctaccgggaggaaggtcggagtctcaaaggctcctgaaaagtag

SEQ ID NO: 25425 - DNA, 1203 bp, Artificial Sequence
  Description of Artificial Sequence: Synthetic coding sequence
atgaccttcgaggatgttgcagtggagttctctcagtgggagtggggccagcttaaccctgcacaaaaggacctgtaccgtgaggttatgctagaaaatttccgtaacctcgccattctggggctgctggtatctaagccttatgtcatctgccagctggaggagggcggagagccgtttatggtcgagcgggagatctctacaggcgctcatagcgactggaaacggagatccaaatccaaggaatccatgccaagctgggggatcagcaaggaggaactctttcaggtggtgtcagtggagaagcatattcaagatgtcctgcagtttagcaagctcaaggcagcatgcggatgtgatgggcagctcgagatgcagcagatcaagcaagaacgccatctcaagcaaatgagcacaattcacaaatcagctacgaccctgagcagagattataagtggaatggcttcgggaggtcattgggcctccgaagtgtgctggttaatcaacacagcattctaatgggggaaggctcctacaagtgcgatacggagtttagacagaccttggggggtaataactctcagcggactcacccagagaaaaagagctgtaaatgtaatgagtgtggaaagtcatttcatttccagtccgaactgagaagacaccaacggtgccataccggcgagaagccatacgagtgcagtgactgcggtcgagcctttggtcacatttcaagcttgataaaacatcagcgcacccatacaggcgagaaaccgtacgaatgttctgagtgcgggagggccttctcacagagttcctcgttggttctgcactataggtttcacacaggagagaaaccctacaagtgcaacgagtgcggcagagcattcggccacacatcgagcctcatcaagcatcagcgtacacacacaggagagaagccttacgagtgtagggaatgcggcagaaccttttctcagagttcatcattgatagttcactatcgttttcacacaggggaaaaaccctataagtgtaataagtgtggccgagccttcagccagtcctctagtctgacacagcattaccgcttccataccggtgagaagccctataaatgcaatgaatgtggcagggccttcgcgcatactgcaagtcttatcaaacaccagcggtcccacgccggtaaaaaaactctctag

SEQ ID NO: 25426 - DNA, 1203 bp, Artificial Sequence
  Description of Artificial Sequence: Synthetic coding sequence
atgacctttgaagatgttgcagttgagttttcccagtgggagtgggggcaactgaatcctgcacagaaggacttgtatcgggaagtgatgttagagaatttccggaacttggcaatcctgggacttctagtgagtaagccttatgtcatctgccagcttgaagagggaggtgaaccattcatggtagagcgggaaataagtactggtgctcactccgactggaagcgccgatcgaaaagtaaggagtctatgcccagttggggcatcagtaaagaggaactgttccaagtggttagtgtcgaaaaacacattcaggacgtccttcagttcagcaagctcaaagccgcttgtggttgcgatgggcagctcgagatgcagcagattaaacaggagcgccacctcaaacagatgagtaccattcacaaaagtgctaccaccctgagcagagattacaaatggaatgggttcggtcggtccctcggtctcagatccgtgctcgtgaatcagcactcgatcctgatgggcgagggctcctataagtgtgacaccgagtttcgccaaactctaggtggaaacaacagtcagcgcacacaccccgagaaaaagtcttgtaagtgcaacgagtgcgggaagagcttccatttccaaagtgagctgaggcgccaccagcgctgtcacacgggggagaagccttatgaatgcagcgactgtgggagggcttttgggcacatctctagcttaatcaagcaccagaggacacatactggggagaagccatatgagtgcagcgaatgcggcagggcctttagccagtcttccagtcttgtgctgcattaccggttccataccggagaaaagccatacaagtgcaacgagtgcggaagagcgttcggccacactagtagcctcattaagcaccagaggacccataccggcgaaaagccatatgagtgtcgggagtgtgggagaacattctcccagtcctcttccctgatcgtgcactacaggtttcatactggggaaaagccctacaagtgcaacaagtgcggccgagcttttagccagagctcctccctcacacagcattatcggttccacaccggggagaagccttacaagtgcaacgaatgcgggagagcatttgcacacacagcgagcctcataaaacatcagagaagccatgctggaaagaaaactctgtag

SEQ ID NO: 25427 - DNA, 162 bp, Artificial Sequence
  Description of Artificial Sequence: Synthetic coding sequence
caatccgagttgcgccgtcatcagagatgccacactggtgagaaaccctacgaatgttctgactgcggaagagccttcgggcacatcagcagcttgattaagcaccaactcatactcgagaagtctcccatgaacgctgtgaacgttggggagccttcttag

SEQ ID NO: 25428 - DNA, 3492 bp, Artificial Sequence
  Description of Artificial Sequence: Synthetic coding sequence
atggaccgcaatagggaggccgagatggagctaagacgtggtccttcccccactagagccggaaggggccatgaggtggacggagataaggccacatgtcacacgtgttgtatttgcggtaaatctttcccattccaatccagcctgtctcagcatatgcgtaaacacaccggcgagaagccatacaagtgcccctactgcgaccacagggcttcgcaaaagggtaatctgaagattcacattcgctctcaccgcaccgggactctcattcaaggccacgagcccgaggctggggaggcgcctttaggcgagatgcgggcaagcgaggggctggacgcctgcgcatccccaaccaagtctgcctctgcctgcaatcggctcctgaacggagcatcccaggccgacggggctcgtgtcctgaacggggcaagccaggcggactctggacgcgtgctactgagatctagtaagaagggcgctgaaggctccgcctgcgcccctggagaggccaaggccgcagtgcaatgtagcttctgtaagtctcaattcgagcgtaaaaaggatctggagctgcacgtgcaccaggcacataagccttttaagtgccgcctgtgtagttatgctaccctcagggaggaatccctgctgtcgcacatcgaaagagatcacatcaccgctcaaggaccgggatctggcgaagcttgtgtggagaacggaaagcctgaattgtcacctggagagtttccctgtgaggtgtgcggccaggccttcagccagacctggtttctgaaggctcatatgaaaaagcatcgaggttcctttgaccacggctgccatatctgcggacggcgattcaaagagccgtggtttttaaagaaccatatgaaggcacacggacctaaaacaggatccaagaaccgacctaaatctgaactggatccaattgcaactattaacaacgtggtccaggaagaggtaattgtagccggactgtccctgtacgaagtgtgcgcgaagtgtggtaatctgtttacaaaccttgattctctgaacgcacacaacgccattcatcgcagagttgaggcctctagaaccagggctccagccgaggagggagctgaggggccatccgacactaagcagttcttccttcagtgtcttaacctgcgaccgtccgctgcgggagactcatgtcctggaacacaagctgggcgaagagtggcggagctggatcccgtcaattcttatcaggcctggcagctggctacccgcggaaaagttgccgaacccgcagaatacttaaagtatggggcatgggatgaagcgctggccggagacgtggccttcgataaggatcgccgtgaatatgtgctggtttcccaggaaaaacggaaacgcgagcaggatgcccctgccgctcagggccctccaaggaaacgagccagcgggccaggcgatccagcaccggctggacatctggacccccgatctgcagccaggcctaatcgacgtgcagccgctaccacaggccagggcaaaagcagcgagtgcttcgagtgtggcaagatctttagaacttatcaccaaatggtcctgcactctagggtgcaccgtagggccagacgagaacgggactctgacggagaccgggctgcacgagcacggtgcggctccctgtcggagggggactctgcaagtcagcctagtagcccgggttctgcctgcgcagcagcagactcgcccggttcagggttagccgatgaagccgctgaggacagcggagaagagggtgcccctgagcccgctcccggtggacagcccaggagatgctgctttagcgaagaagtcacctccaccgaactgtcctctggggaccagtcccataagatgggtgacaacgcctctgagagagatacgggcgagagcaaggccggaatcgcggcaagcgttagtatcttggaaaattcaagccgagagacctcacgcagacaggagcaacatagattctctatggatctgaagatgcctgcttttcatccaaagcaggaggtccccgtccctggcgatggcgttgagtttccctcgtcgaccggcgctgagggccagactggacatcctgcagaaaaactgtccgacctccacaacaaagagcactctggaggtgggaaaagggcccttgccccagatctcatgccgctggatctctccgctcggagcacacgcgacgacccatccaacaaggagaccgcctctagcttacaggctgcactcgtcgttcatccctgtccctattgctctcacaagacctactatcccgaagtgctgtggatgcataaacggatttggcatagggtgagttgcaatagcgtggcacctccatggattcaaccaaacggatacaagtcaattcgctctaatctggtgttcctgagtagatcaggccgtaccgggccaccaccagccctcggtgggaaagagtgtcagccactcttgctggccaggtttaccagaacacaggtgcccggtgggatgcccggaagcaaatctggatcctctccgcttggggtggtgactaaagcagccagtatgcctaaaaataaagagtctcactcaggaggaccgtgtgccctgtgggccccaggaccggacgggtatcgccagacgaagccctgtcacggccaggaaccgcatggagcggcaactcagggaccactggccaagcctcgtcaggaggcaagcagcaaacccgtcccagctccgggaggcggaggattctcaagatcagccactcctacccccaccgtgatcgccagggccggtgcccagccttccgccaatagtaagccggtggagaagttcggggtgccccctgcgggagctggttttgcgccaaccaacaaacacagcgccccagattcccttaaagcaaagttttctgcacagccccaaggacccccacctgcaaaaggggagggaggtgctcctcccttgcctccccgagaaccccctagcaaggctgcccaggagctcaggactctggcaacgtgtgccgctggttcccggggagatgcagcgctgcaagcccaacctggggtcgctggagcccctcccgtcctccacagcatcaaacaggaacccgtcgcggagggccatgagaaacgcctggacatcctgaatatcttcaagacctatatcccaaaggattttgcaacgctgtatcaggggtggggcgtgtccggcccaggcctcgagcaccggggaactctgcgcacccaagccagacccggagaattcgtgtgcatcgaatgtggtaagtcatttcatcagcccggtcacctcagagcccacatgcgagctcattctgtcgtgttcgaaagtgacggacctagaggaagcgaggtgcatactacgtccgcagatgccccaaagcagggcagggaccattcaaatactggtaccgtccagacagtgccacttcgcaaggggacatag

SEQ ID NO: 25429 - DNA, 228 bp, Artificial Sequence
  Description of Artificial Sequence: Synthetic coding sequence
atggatagaaaccgcgaggctgagatggagctaagacgtgggccatctcctaccagagctggtcgtggtcacgaggtggacggcgacaaggctacctgccacacatgctgtatttgcggcaagtcctttccattccagtcttctctgtcgcagcacatgcgaaaacacaccggcgagaaaccctataagtgtccttactgcgatcatagggcaagtcaaaaaggctag

SEQ ID NO: 25430 - DNA, 1479 bp, Artificial Sequence
  Description of Artificial Sequence: Synthetic coding sequence
atggccatggctctgccaatgccaggaccgcaggaggccgtagtgtttgaggacgtagcagtctacttcaccaggatcgagtggagctgcctggcccctgatcagcaggctctgtaccgggatgtaatgttggagaattatggtaacctcgcttcactcgggtttttagtggctaagccagcacttatttctctgcttgagcagggcgaggagcccggagccctgatcctccaggtggccgagcagtcagtggcgaaggcttctctctgcacagacagtcgcatggaagccggaatcatggaaagtccactgcaaagaaagctgtctcgacaagctgggttgcccggtaccgtttggggatgtctcccctggggccatcctgttggcggtcaccctgcccctcctcacccgcatggaggtccagaggatggctcagacaaaccgacccacccgagggcacgcgagcactcggcgtccccccgtgtgctgcaggaagatttgggcaggccagtcggtagctccgcccctagataccgttgtgtgtgtggtaaggcctttcgctataactctcttcttctgcgccaccagatcattcacacaggcgctaaaccctttcagtgtaccgaatgcgggaaagcctttaaacagagtagtatactgcttcgtcatcaactgatccatacagaggagaaaccctttcagtgtggcgagtgcgggaaggcctttagacaaagtacgcagttggccgcacatcatcgtgttcacacaagagaacggccttatgcatgtggggaatgcggcaaagctttctctcggagctcaaggctgctgcagcatcaaaagttccatactggcgaaaaaccattcgcatgcaccgaatgtggtaaagcattttgcagaaggttcaccctaaacgaacatggtaggattcatagcggcgagcgcccttacaggtgccttcgatgtgggcaacggttcattcgcggaagtagtctgctgaagcaccatagattgcacgcccaggaaggggcacaggacggcggtgtcggccagggggctctattgggggcagcccagagaccacaggctggcgaccccccacacgaatgtcctgtatgcggccgtccctttcgacacaattccctgttactgctgcatctcaggctgcatacaggagagaagccatttgagtgcgccgaatgtggcaaggcttttggtagaaagagcaaccttaccctccatcagaagatccataccaaagagaagcctttcgcctgcacagaatgtggaaaggcatttcgcagatcctatacactcaacgagcattaccgcttacatagcggagagcgaccataccgctgtcgcgcatgcggacgggcatgttcacgcttaagcactctgatccaacatcagaaggtccatggcagggagcctggagaagatactgagggacggagagctccatgctgggcaagttag

SEQ ID NO: 25431 - DNA, 1479 bp, Artificial Sequence
  Description of Artificial Sequence: Synthetic coding sequence
atggcgatggccctgcctatgcctgggccacaggaagctgtggtgttcgaggacgtcgcagtgtatttcacacggattgaatggtcctgtctggcaccagatcaacaggcactgtatagggacgtcatgctggaaaactacgggaatctggcgtccttgggcttcttggtagctaagccagctcttatatccttgctagagcagggagaggagccgggagccttaatcctgcaggtggctgaacaatccgtagccaaggcgtcactgtgcactgattccagaatggaggccggtatcatggaatcaccactgcagcggaaactgagtcgtcaagcgggattacctggaacagtatggggatgtcttccctggggtcaccctgtgggcggacatcccgcacctccacaccctcacggaggacctgaagacggatccgataagccaactcatcctagggcacgcgagcactcggctagcccccgagtgctgcaggaagacctgggaaggcctgtgggcagctcggcccctaggtacaggtgcgtgtgcgggaaagcattccggtataacagtcttctgttgcgccaccagattatccatacaggggcaaagccctttcagtgtaccgaatgtggcaaggcatttaaacagagcagtatcctccttcggcaccagctgatccacacggaagagaaacccttccagtgtggtgagtgcggcaaggcctttagacagtcgacacagctcgccgctcaccaccgcgtgcacactagagagaggccttatgcatgcggggagtgcggaaaagcattttctcggagctctagacttctccaacatcagaagtttcatactggggaaaagcccttcgcatgtacagagtgtggcaaggctttttgccgacggttcactttaaacgagcacggcagaatccactcaggtgagaggccctatcgctgcctgcggtgcggccagcgttttatacgcggaagttctctccttaaacaccaccgattacatgcgcaggagggcgcacaggatggtggcgtgggccagggagctctcctgggtgcagcccagagaccccaggctggcgacccaccccacgaatgtcccgtatgcggaagaccctttcgacataactctctgctcttactgcacctgcggttgcacaccggcgagaaaccatttgaatgcgcggaatgcggtaaggccttcggaaggaagtcaaacctgaccctgcatcagaaaattcacactaaggagaaacccttcgcttgcaccgagtgtgggaaagcctttaggcggagctatacactgaatgaacactacagactccattcaggagaaaggccgtatagatgtcgcgcatgcggtcgcgcatgcagtagactatctactcttatccaacatcagaaagttcacggccgagaacccggagaggacaccgaggggagacgcgcaccttgttgggcaagctag

SEQ ID NO: 25432 - DNA, 1479 bp, Artificial Sequence
  Description of Artificial Sequence: Synthetic coding sequence
atggccatggctctgccaatgcctgggccacaagaggccgtggtctttgaggacgtcgcggtctacttcactcggattgaatggagttgtctggcgccagaccaacaggccctgtaccgggacgtcatgctcgagaactatgggaatctcgcttcactaggctttcttgtggcaaaacccgcactcatttctctgcttgaacaaggagaagagcccggtgccctgattttgcaggtggcggaacaaagcgtagccaaagcttcgctctgcactgacagccgcatggaggctgggataatggagagccccctgcagcgtaagctgtccaggcaagcagggctgccgggaactgtatgggggtgtctcccctgggggcaccccgttggagggcaccccgcaccgcctcacccgcacggcggtcctgaggacggctctgataagccaacacaccctagagctagagagcatagtgcttccccaagggtgctgcaggaagatttgggcaggcccgtgggctcctccgcccctaggtacaggtgcgtgtgcggcaaggcgtttcggtataattctctattacttaggcatcaaataatacatacgggcgctaaaccattccagtgtacagagtgcggtaaagccttcaagcaatcatccattttgcttcggcaccagttaattcatactgaagagaaaccattccaatgcggagaatgcggaaaagcgtttcggcagtcaacccaacttgccgctcatcacagagtgcacaccagggagcgtccatacgcctgcggcgagtgtggcaaggcttttagccgttccagtcgattactccagcaccagaagtttcacactggggagaagccctttgcgtgcaccgagtgcgggaaagcattctgtagacgatttaccctgaacgaacacgggaggattcatagcggtgagaggccttatagatgcctccggtgcggacagcgcttcatcagaggatcatccctgctgaagcaccatagactacacgctcaggagggggcacaggatggcggtgtagggcaaggggcactgttgggagccgcacagagacctcaggccggagatcccccacacgagtgccctgtctgcggccgtccctttcgccacaactccttgttgctgttgcacttgaggcttcacacaggcgagaagccattcgagtgcgctgagtgcggcaaggcctttgggaggaaatccaatttaacactccatcagaaaattcacacaaaagaaaaaccctttgcatgcactgaatgtggtaaggcttttcgcagaagctatactctcaatgagcattacaggctgcattcgggcgagcggccatatcgctgcagggcttgtggtagggcatgtagccgcttgtcaactctgatccagcatcagaaggtgcacggaagagagccaggcgaagatactgaaggtagaagggccccatgttgggcatcttag

SEQ ID NO: 25433 - DNA, 3225 bp, Artificial Sequence
  Description of Artificial Sequence: Synthetic coding sequence
atgaaggacatcggtcagcagctgtacaccacacacttgaacggaggacacaacagcctgaccatgagccccaagcagccagatgctaatggggcaccacgacctaatcggcaggaggcccagaccttactgtatcagggaagtgaggccgaagccgctatgatgaccattgcaacctgcgctaagtgcaagtcagtacacaagatctctctgcaggatctgcagaagggtacaggcaaagatggaatgtatgtttgttttcagtgcagtctgggggctgccccacctaacttccatttcgtctccaacaacagtagtgcgacacatgtgggaaataaaaccgaaaacttcagctccagcgtcaacagcaagtttaaggtgcggaatttcaagccagggaagtactattgtgataagtgccggttctctacaaaagatccccttcagtacaagaagcacactctacagcatgaggagattaaattcatttgctcccattgcagctacattagttacacaaaaggtgagttccaacggcacctcgtcaagcatacagggatctttccataccagtgtgagtactgtgattacggggctattaggaatgattacatcgtgaagcataccaagagagtgcacgaacgggctggtgcgaagcgacctgtgaaagcagtggctaagctggaacccaaacggaccggtaccagtaagcagaatcccgagcttctcaaagcctccaacccaaggactacattccagaacaagtggtccgaccaactgagcggctttagtctccacgcaaacaaggataagatgcacaacattatgctgctccctgagccaaaggagtatcagaaagacgtcgtgtgtatccctaacaaaatgaccctgtcggagccaaatgaggtaaacctgtttgaaaacaaaaacgtggaagtggaagtcctgagtccagctaaggagcctgtccaaccgggtatgcccctcactgtggtcgccccagcagagcttgtggtgcctgccaattgcctggcgcagctaattgacgtcaaagtggttaacggaacccagcagcttgtgttaaagctgttccccctcgaagaaaacaactgtctagaggcaggccgagacaacggtggcaactctgaacgtatggtaaaagaaaagggctccaacgaacaagaaaaagtgctgtctgccgagaagaccaagagcctgaccgttgatgggaacgtgggcaaattagtaggaatagattcttttcagccttccgtccagaaacagctaaagaatgtaaagtgggtgaggagttatgacttcatcatgccaaattcatctgtgcacaataacggcaaatcctttatcaacagcgaaactatcgaggattttcagaagaaaaataacctgtacccccaccgcaccgcttttccgtctgtggcacttaaagggcattcccttgcctctgtattcaaaaacagtgtcctgcggtccctcggcgcagccagcaacccctttccatataaggcagccgtgtgctttgccgaatcgggacgaaatcttcacagttctagccaacagctgcttccgtttgctgctagccccgcaacctgttccttctcgggcgaaaaagggctgttaccggtctctgagaacgacttagagtccaccagcaaagtcaacatcccagtgaaggttgtatcatctaataggaagcaggaggataatcagactgaggagcacaaagctgttagcactgtcgggcagatctcatcacaacacaaaagcgaataccttcacattaatataacaggggaagatagatcccagcagccaggggataaacctctggagttgaagaattcagaaagaacgaataacaccaacgatggtccggtgatatcatctgtgttcagcctctcttctggttcagagaacgtgcctgaagggatcaagtggaatagttctactagtaagataaaatcaattgagctgctgcggaggaaaatagctcagcttattgaaagctgtggaaaacccagctccctcgcttctaactccgcccatagacgcagcgtcgggcaggcttctaaagggacatccaaggccacgtccgagggtatccaagaaattaacgtcagcttaacgggattgggtcactcaactgggactctgcagaaacctcctaacgacggcggaatcaccggcaaccggcagctgacacaccagcaaatctatccacacttcgctgacggctccaatcgtaaaacaaaaagccgcgtggccaggaaggcccatgtggcgactcccgtactgatccctaaaggggcagtgctccgggtgctgaacagttctgaaaatgctcatattatagaagctacctgtgaagccccagtttcaattccatgttccgaaaggcagcttatcaagcccgtccctttctgtcctgtaagacaggccgatagtgatctgcaacccctgagatccgagcgcggacccatcgatatgagtcccaacattgaaacccccctgcgacctaagctgcggaaagagtcggccgtgtgctctacgatacatagaaaaaccgggctgctatacggacagcaaggttcaagcgaattgaataagcaggggagactgctgagccgttctctgtcgatctcacggaacaagacgaagcaggtgcatctgagccgcaaaaaaaataaaatccaggccgaaccctctagatgcctgaaggacccctccatattccaggtggccagacagctgagactcatcgccgctaaacctgaccagttaataaaatgtcccagacggaaccaaccagtaattgtgctgaatcaccctgacgtggacagtcccgaggtgacaaacgttatgaaggtgatcaataagtacaagggcaacgtgttaaaggtggtcttatccgagaggacaagatgccaactgggtatccgcagacaccatgtcagactgacataccaaaatgcagaggaggcatctcaaatcaagagacaaatgatgctgaagatgaagctgaagaaggtccataaaaacaattaccaggtcgtagattctctgcccgacgacagttcccagtgtgtgttcaagtgctggttctgcggccgattgtacgaagaccaggaggaatggatgtctcatggacagcgtcacctgatagaggcgacgagagactgggacgtactgtcaagtaagggtaaatag

SEQ ID NO: 25434 - DNA, 228 bp, Artificial Sequence
  Description of Artificial Sequence: Synthetic coding sequence
atgaaagatataggccaacagctttacaccacacatctgaacggtgggcataactccctgacaatgtcaccaaaacagcctgatgccaatggagcgcctcgccctaaccggcaggaggcccagaccttgctttatcaggggtcggaagccgaggctgccatgatgacaatagccacatgtgccaaatgcaagagtgtccataagatctccctccaagatttgcagtag

SEQ ID NO: 25435 - DNA, 1623 bp, Artificial Sequence
  Description of Artificial Sequence: Synthetic coding sequence
atggagttgctcacctttcgcgatgtcgccatcgagttttctcctgaagaatggaagtgtctggatcccgctcagcagaacttatacagagatgtgatgctggaaaattaccgaaacctggtgtcactggcggtttattcctactacaatcaggggatactgcccgagcaaggtatacaagattcgttcaagaaagctaccctgggcagatatggcagctgtggactggagaacatctgcttgtggaagaactgggaatcgatcggagaaggcgaaggacagaaggagtgttacaatctctgttcccagtacctaacaacctcgcacaataaacatctcacagtgaagggcgataaggaatacaggattttccagaagaagccccagttcctgtcagccgcacccacagaaccctgcatacccatgaataagtaccagcataagtttctgaagagcgtgttttgcaacaaaaaccagattaatttcaatcacgattccaacatcagcaaacatcactctacccacttcctggagaattattacaactgtaacgagtgcgaaaaagtgttttatcagtcttctaaattaatctttcccgagaacatccatatccagaaaaaaccgtataatagtaatgagtgcggggagacgtcagacccattcagcaagctcactcagcaccagcgcatctacattggagaaagctcccaaaggtgcaataaaaagtgcatcatcgtattttctcagagtcatcttaaggggcacaaaattatcaatacaggagagaaatcagtgaagtataaggaacggggtaaagcattcaccagaggtcttcatctgggtcaccagaagattcacactggggaaaagccctacaagtgcaaaaaatgcgacaaagcgtttaataaatctagtcacctcgctcaacaccagagaatccacacgggggagaaaccttttaaatgcaaggagtgtggaaaggccttcaaccggggtagctatctgactcagcatcaaaggattcacaccggggagcgagccttcaagtgcgaggagtgcggcaaagcctttaatcgagggtcctaccttacacagcatcaacgcatccacactggcgagaagccttttagatgtaaggaatgtggtaaagcttttaaccgttcttcatatgtaactcagcaccagcgtatgcatacaggggagaagccgtttaagtgtaaggaatgtggcaaagcgtttaaccgcgcaagccacctgacccagcaccagcgcatacacacgggggaaaagcactttaaatgtaaggagtgcgggaaagccttcaatcggggatcacacctgactaggcatcagagaatccacaccggagaaaagagctttaagtgcgaggagtgcggcaaagcctttatatggggcagccatctgactcagcaccaacgggttcacactggagagaaattttttaagtgcaaagaatgtggaaaggcattcacccggtcttcccatctgacccagcaccaaagaatacatacgggcgaaaaaccctttaaatgcaaggagtgtggtaaggcctttaaccgacgcagtactctaacccagcaccagatcatccacactcggtag

SEQ ID NO: 25436 - DNA, 1623 bp, Artificial Sequence
  Description of Artificial Sequence: Synthetic coding sequence
atggagttgttgacctttcgcgatgtggccatcgaattcagtccagaggagtggaaatgcttagaccccgctcaacaaaacctgtaccgggacgtaatgctggaaaattaccgcaatctcgtgtctttggcagtctactcttattataaccagggcatattgccggaacaggggattcaagattcctttaaaaaggcgacgctgggacgctatggcagctgtggactcgagaatatttgcctctggaagaattgggaatccattggcgaaggcgagggccagaaagaatgctacaatctgtgttcacagtatctgaccacttcccacaacaagcacttgacagtaaaaggtgataaagaatacagaatattccagaagaaaccccaatttctttccgctgctcctacagaaccttgtattcctatgaacaagtaccagcataaattcctcaaaagcgtgttttgcaacaagaaccagattaattttaatcacgattccaatatctctaagcatcattcaacacacttcctggaaaactactataattgtaacgaatgtgagaaggtcttctatcaatcatcaaagcttatcttcccagagaatatccacattcagaaaaagccctataactctaatgaatgtggggagacttcagacccgttctccaaattgacacagcatcagcgaatttacatcggtgagtctagtcagcgctgtaacaagaaatgcattatcgtgttttcacagagccacctgaaaggacataagattataaataccggcgagaagtccgtgaagtacaaggagaggggtaaagctttcactagagggctacatcttggacaccagaagatccacactggggagaaaccatacaaatgcaagaaatgcgataaggcgttcaataagtcatcacatttggcccagcaccagaggatacatacaggggaaaagcctttcaaatgcaaggaatgtggaaaagccttcaataggggctcctaccttacacagcaccagcgcattcacaccggcgaacgtgcatttaagtgcgaggaatgcgggaaagcctttaatcggggtagctacctgactcaacatcagcggatccatacaggtgaaaagcccttccgttgtaaggaatgcggcaaggccttcaataggtcatcttatgtgacccagcatcagaggatgcacaccggggaaaagccatttaagtgtaaagagtgcggcaaggcatttaatagagcgtcccatctgacgcaacatcagcgaatccacactggtgagaaacacttcaaatgcaaagagtgcggaaaagcttttaaccggggatcacatcttactcggcaccagcgcattcatactggcgaaaaatccttcaagtgtgaagagtgcggaaaggcattcatttggggcagccacttgactcagcaccagagggtccatactggcgaaaagttttttaaatgtaaggaatgtgggaaggccttcactcgttcaagtcatctgacccaacatcaaagaatccacactggcgagaagccttttaaatgtaaagagtgcggcaaagcattcaacagacggtcaaccctcacacaacatcagatcatacacacaaggtag

SEQ ID NO: 25437 - DNA, 795 bp, Artificial Sequence
  Description of Artificial Sequence: Synthetic coding sequence
atggacaccccctccccagacccattaccctccccactgcctggcgaggaggaaaaaccattggctctttctccacctgtcccccgaggcaggcgagggagaaggccaggtggagctacttcatctaataggaccttgaaagccagcctgccacgcaagagagggcgtccccctaaatctgggcaagaacccccacttgtgcaggttcagggggtgacggctcccgtgggctcttctggcggatcggatttgcttctcatagacgatcagggtgttccttataccgtgtccgaaggatctgctgccggtcctgaggggtcaggaccacgcaaggctccacatttttgccctgtgtgtctgcgcgcatttccctacctgtccgatcttgagaggcattccatctcgcactcagagctgaaaccacaccaatgcaaagtatgtggcaaaactttcaaacggtcatcacacctccgacggcattgtaacattcatgccggactccggcctttcagatgtccactctgtcctcgccgttttcgcgaagctggtgaactggcacaccatcacagagtgcactccggagagcggccttatcagtgtcccatctgcaggctgagattcacggaagccaacacgttacggcgtcacgccaaaagaaagcaccccgaggcgatgggagtccccctctgcgctccagaccctggaagtgaacccccatgggatgaggaaggaatccctgcgacggctggagccgaggaagaagaggagaccgaaggaaaaggagaacccgcatag

SEQ ID NO: 25438 - DNA, 594 bp, Artificial Sequence
  Description of Artificial Sequence: Synthetic coding sequence
atgtcatcactcacataccaccacagactgcacacaggagagaagccatacaagtgtgaggaatgtgataaggctttccgtcacaactcagccctccagcgccacagacggattcatacaggcgaaaagccccacaaatgcaatgagtgcgggaagacgttttctcagaagagctacttggcctgccatagaagcattcacaccggcaaaaaaccctatgaatgcgaagaatgcgataaggctttctccttcaaatctaacttggaaagccatcgtataactcatacaggagaaaagccttataagtgtaacgattgcgggaagactttttctcacatgagcacactcacctgccacaggagactgcacactggcgaaaagccttataagtgcgaggaatgcgatgaggcgtttaggtttaagtcaagccttgagaggcaccgcaggatccacaatggggaaaaactgtacaaatgcaatgaatgcggtaagaccttcagccaggagttgtctctcacttgccactgtcgcttacacagtggggaaaagccgtgcaagtgcggagagtgtgacaaggcttacagctttaagtag

SEQ ID NO: 25439 - DNA, 1332 bp, Artificial Sequence
  Description of Artificial Sequence: Synthetic coding sequence
atgctggaaaattatcgcaacctggtctctctgggcattagctcaaaatgcaccatgaaagaattttcaagcaccgcacaaggcaataccgaagtcattcacactggaactctgcagcgacatgagaggcaccatatcggcgacttctctttccaagaaattgaaaaagacatccataattttgagttccagtggcaagaagatgaacgaaacggtcatgaagctcctatgactaagataaagaaactgatgggtagcactgagcagtacgatcacaggcatgccggaaataaaccaatcaagtatcaattaggctcaagcttccacagccacctgtccgaattgcatatatttcagcctaagggaaagattaacaatcaagtagaaaagagtatcaatgatgcgtctagcgtaagcactgcgcaaaggatctcttgtcgcccaaagacacatatttctaataactatggagacaatttcctgaattacagtctcttgacccagaggcaggaggttaggatgcgggagaaatcttttcagtgcatcgaatcagggaaggcatttaattactccagtttactgaggaagcaccagattattcacttgggagagaaacagtacaagtgtgatgtctgtgacaaagtctttataagaaagcgctacttggccaggcaccgcaggtgccacaccggagaaaagccatacaagtgcaatgagtgtggaaagtcattcagccagatgagcagcttgacatatcaccaccggctgcataccggagaaaagccttataagtgtgaggagtgcgataaggcattccggcataactccgcactccagcgtcatcgacgtatccatacaggggagaaaccacataagtgtaacgagtgtggaaagactttctctcagaagtcttaccttgcatgccacaggagcatccacacgggcaagaaaccctacgaatgtgaagaatgtgacaaagccttttctttcaagagcaatttagaaagtcacaggattacacatactggtgagaagccatataaatgcaatgactgcggcaaaactttctcccacatgagcaccctcacttgtcatcggcgattacatactggcgaaaaaccttataaatgtgaagaatgtgacgaggcatttcgatttaagagctctttagaacgccaccgacgaatccataacggtgaaaagctgtataaatgtaatgaatgcgggaagacctttagccaggagctgagtctgacttgtcattgtcgtcttcattctggtgaaaagccctgtaagtgcggcgagtgcgataaggcctactcttttaagtag

SEQ ID NO: 25440 - DNA, 1440 bp, Artificial Sequence
  Description of Artificial Sequence: Synthetic coding sequence
atggccctcccacaggggttgcttacatttagagacgtagctattgaattttcccaagaggagtggaaatgccttgaccccgcacagcgcaccctgtaccgggatgtcatgctcgagaattataggaatctcgtgtctctgggcatcagcagtaaatgcactatgaaggaattctctagcacagcccagggaaataccgaggtgatacatacgggaaccttgcagagacacgagagacatcatatcggggatttctcctttcaagaaatagagaaggacatacacaacttcgaattccaatggcaggaggacgagagaaatgggcatgaggctccaatgaccaagataaaaaaactcatgggatccacggagcaatatgaccatcggcatgccggtaataaacctatcaaataccaactgggaagctcctttcacagccatctatccgagctccacattttccagcctaaggggaaaatcaataaccaggtggaaaagtctattaatgacgcgtcctccgtgagtactgcccagcggataagttgccgaccaaaaacgcacatctcaaacaactatggtgacaacttccttaattattccctcctgacacaaaggcaggaggtccgaatgagagagaagtcttttcagtgcatcgagtccggaaaagcattcaattatagcagcctcctgagaaaacaccagattattcacttaggcgaaaaacagtacaagtgcgatgtttgcgataaagtcttcataaggaagaggtacctcgccagacaccgccgttgccatacaggcgaaaaaccttacaagtgtaatgagtgtggcaagagcttttctcagatgtccagcctaacctaccaccatcggctgcataccggcgaaaagccctataaatgcgaggagtgcgacaaagctttcaggcataacagcgcgctccagcgacaccgacgcatacacacaggcgaaaagcctcacaaatgtaatgaatgcggcaaaactttcagtcagaagtcatacttggcctgccacaggagcatccacacgggcaagaagccttatgagtgcgaggaatgcgataaggcgttctctttcaagtctaacctggagtcacaccgtattacacatacgggggaaaaaccttacaagtgcaatgattgtggcaagacattttcccacatgtctaccctcacctgccacaggcgtctccatactggagagaagccttataagtgtgaagagtgcgacgaagcgtttaggtttaagagctctttagaaagacacaggcggattcacaatggagagaaactgtataagtgtaatgaatgcggcaagaccttctcccaggaactgtccctaacgtgccactgccgcctgcactccggggagaagccgtgcaagtgtggcgaatgcgataaagcatacagctttaagtag

SEQ ID NO: 25441 - DNA, 153 bp, Artificial Sequence
  Description of Artificial Sequence: Synthetic coding sequence
atggctttaccgcagggacttctgactttcagggacgttgccatcgaattctcccaagaggaatggaagtgccttgatcccgcacagcgtactctctacagagatgtcatgttagagaactatagaaatcttgtgtcattgggcttcctctag

SEQ ID NO: 25442 - DNA, 1887 bp, Artificial Sequence
  Description of Artificial Sequence: Synthetic coding sequence
atggcactgacccaaggcccattgaagtttatggacgtggcaatcgaattttcacaggaggagtggaagtgtctggatccagcacagcgcacactgtatagagacgtgatgctcgagaactaccgaaatctcgtatcattgggcatttgccttcctgacctatctgtgactagtatgctggaacagaagcgggacccttggactctgcagtctgaagaaaagatcgccaatgaccccgatgggagagagtgcattaagggggtgaacaccgagcgatccagtaagttaggctcaaatgctggcaataagccatgtaaaaatcagctgggcttcacatttcagctgcacctgtcagatctgcaattattccaggcggagaggaagatttctggatgcaagcattttgaaaaacctgtaagcgacaactcaagcgttagtcctctggaaaaaatctcctcaagcgtgaagtcacaccttctaaataagtataggaacaactttgaccacgcccctttgctgccgcaggaacagaaagcacatatccgcgagaaggcctacaaatgcaacgagcatggccaagtcttcagggcaagtgcctccctgaccaaccaggtgatccataacgcagataatccctacaagtgtagcgaatgcgggaaggtgtttagttgttcttccaaactcgttatccatagacggatgcatacaggagagaagccttacaagtgtcatgagtgtggcaagctcttttcatctaatagcaatctcagtcagcatcaacggatccataccggtgagaaaccctataagtgtcacgaatgcgacaaggtcttccgcagcagtagcaaactcgcacagcaccagagaattcacactggagaaaagccctacaaatgccacgagtgcgacaaagtcttcaatcaaatagcgcacctagtccgccaccagaagattcacaccggcgagaaaccctactcctgtaacaaatgtgggaaggtgttctccagacattcttatttagctgaacaccagactgtccacactggcgagaaaccgtacaagtgcgaggagtgtggaaaagcattttccgtacgctcaagcctcatcactcaccagttgatccacactggacggaagccttacaagtgcaaggaatgtgacaaagtttttggtcggaagtgtttcctgacttcgcatcagcggatccacactagagagagaccttatggttgtagtcagtgtggcaaaattttttcccagaagagcgaccttatccgccaccggaagactcatacagacgagaagccatataagtgcaacaaatgcggtacggccttccgggagttttcagacttgacggcgcactttctcatccacagcggggaaaaaccgtatgagtgtaaggaatgcgggaaagtgtttagatacaagtctagtctcacaagccaccaccggatacatacaggcgaaaagccgtacaaatgtaacaggtgtgggaaggtcttcagtaggtcatctaatcttgtttgccatcagaaaatccacacaggagaaaagccgtacaaatgcaatcagtgtgggaaagtgttcaatcaagcctcctatctcacacggcaccagattatacacacgggcgagaggccctatcgctgctctaagtgcggtaaagctttccggggttgttcaggcctcactgcacacctggctatccacactgagaagaagagccatgaatgcaaggaatgtggaaaaatattcacacagaagtctagcctgaccaatcatcatcgtatccatatcggcgagaaaccgtacaaatgcacactctgctctaaagtattctctcacaactctgacctggcccaacaccagcgcgtgcacagttag

SEQ ID NO: 25443 - DNA, 246 bp, Artificial Sequence
  Description of Artificial Sequence: Synthetic coding sequence
atggccttgacacagggcccattaaaattcatggatgtagcgattgagttctcccaggaggagtggaagtgcttggatccagcccagcgcacactgtaccgcgacgtgatgttggagaactatagaaacctggtcagcttgggcatttgcctcccagacctgagtgttaccagcatgttggagcagaagagagatccgtggacccttcagtctgaagagaaaattgccaacgatcccgacgggtag

SEQ ID NO: 25444 - DNA, 45 bp, Artificial Sequence
  Description of Artificial Sequence: Synthetic coding sequence
atggctttgacccaggggccactcaagtttatggatgtggcttag

SEQ ID NO: 25445 - DNA, 1800 bp, Artificial Sequence
  Description of Artificial Sequence: Synthetic coding sequence
atggccgctgctctcagggcgcctacccagcaggtcttcgtggcattcgaagatgtggctatctacttcagccaggaggaatgggaattactcgacgagatgcagcgattactgtaccgagatgtaatgctggaaaatttcgcggtgatggcatctctgggatgttggtgtggtgccgtggacgaagggacgccaagtgcagaaagcgtttctgtagaggaactgtcccagggcaggacacccaaggcagacacttccaccgacaaatcgcacccctgtgagatctgcacgcccgttctgagggatatcctccaaatgattgaacttcacgcaagcccctgtggacagaagctgtacttgggaggggcttccagggacttctggatgtctagcaacctgcaccagctccaaaagctggacaacggagagaagttgttcaaggtcgacggagaccaagcgagttttatgatgaattgcaggtttcatgtatccgggaagcccttcacattcggtgaggtcgggagggacttcagtgccacatctgggttattgcagcatcaggttacccctactatagaacgccctcactcacggattcgtcacctcagggtgcctacaggcagaaaaccactaaaatacaccgagagccggaagagcttccgggaaaaatcggtattcattcagcatcagcgggcagatagcggcgagaggccttataaatgttccgagtgcggcaagagttttagccagtcatctggctttttaagacataggaaggcccacggacgaacgcgcacccatgagtgctcagaatgtggtaagagtttctctaggaaaacgcacctgacgcagcaccaaagagtccacactggcgagcgtccttacgattgtagtgagtgcggaaagtcatttcgtcaagtctctgtgctaattcaacatcaaagagtgcacactggagaacgtccctatgagtgttcagagtgcggaaagtctttctctcacagcactaatctgtacagacaccgctctgcacatacatccacccgtccttacgagtgctcagagtgtgggaagtcattcagccattccaccaacttattccgacactggagagtgcatacaggtgtacgcccatacgaatgcagcgaatgcggaaaagctttttcctgtaacatttatctgatccatcaccagaggttccacactggtgaacggccttacgtgtgcagcgagtgcggcaaatccttcggccaaaagagtgtattgatccaacaccagagggtgcatactggtgagcggccttacgaatgctcagaatgtggcaaggtcttttcacaatcgagcggactctttcggcacagacgagcccacaccaagacaaaaccatacgagtgctccgaatgtgaaaaaagcttttcctgcaaaaccgatttgataagacatcagacagtgcatactggtgagcggccttatgagtgctccgtctgcggcaagtccttcattagaaagacacatctgattcggcatcagaccgtgcacacgaacgagcggccatatgaatgtgacgagtgcggcaaatcgtactcacaatcttctgccctgctgcagcaccgcagagtccatactggcgaacgcccatatgaatgtcgcgaatgcgggaagagctttacacggaagaatcacctgatccagcataagaccgtgcacacaggcgaacggccttatgaatgttcagaatgtgggaagtcctttagccagtcttctgggcttctgcggcaccgcagagtgcacgtccaatag

SEQ ID NO: 25446 - DNA, 3906 bp, Artificial Sequence
  Description of Artificial Sequence: Synthetic coding sequence
atgactatgggagacatgaagacaccagatttcgacgacttgctagccgctttcgatattccagatatggtagatcccaaagcagctatagaatcaggacacgacgatcacgagtctcacatgaagcagaacgcacatggggaagacgactcgcatgccccttctagcagcgacgtcggagtgagcgtcattgttaaaaatgttcgtaatattgacagttccgagggcggagagaaggatggccataaccccacgggcaacggtctgcataatgggttcctgacagcctcctccctcgactcctactcaaaggatggggcaaagagtcttaagggagacgtgcctgcctccgaggtgacgttgaaggactccacttttagtcaattttcccctataagttctgccgaggagttcgatgacgacgagaaaatcgaagtcgatgatccgccagataaagaggacatgcgctcgagtttccggagcaatgtgctcacaggctccgctccccaacaggactatgataaactgaaagcacttgggggagagaactcatccaaaacagggctgtcaacaagcggaaacgtggagaaaaacaaggcagtgaagcgggagaccgaagcaagcagtattaatctctctgtctacgagcccttcaaggtgcgcaaggctgaagataagctgaaggaatcaagtgacaaggtgttggagaaccgcgtgctggacggcaaactgagctccgaaaaaaacgatacttccttgcccagtgtggcaccctctaagactaaatcatcatctaaacttagctcatgcattgccgctatcgctgcccttagcgcaaaaaaagctgcaagcgactcttgcaaagaaccagtcgcaaatagccgcgaatcttctccattgcctaaagaagtgaatgattcaccacgagcagcggacaagtctcccgagagccaaaacctgatagacgggacaaaaaaacctagcctcaaacagcccgatagccccaggtctatctccagtgaaaactcgtcgaagggcagcccctcatccccggctggatccacacccgctatccccaaggtgcggattaagacaattaagacctctagcggagaaatcaagcgaactgttacacgggtgctgcccgaagtggatttggatagcggcaagaaaccttctgagcagactgccagcgtaatggcaagcgtcaccagtttgttgtcgagtcctgcctctgcggctgtgctatcaagccccccacgcgctccgcttcagtctgccgtggtaacaaacgccgtgtctcccgctgagctcacaccaaagcaggtgaccatcaaaccagtggctactgccttcctgcctgtcagcgcggttaaaacagcagggagtcaagtgatcaatttgaaattagctaacaatactacagtgaaggccaccgtgatttccgctgcaagcgtccagagcgcctcttctgctatcatcaaggcagctaacgctattcagcagcagaccgtggttgttcctgcgtcttcgcttgcgaacgcaaaactcgtgcctaagactgttcaccttgcaaatttgaacttactgcctcagggagctcaggcaaccagtgaactgcgacaggtgctgacaaaacctcaacagcagatcaagcaggcgataataaatgctgccgcttcccagcctcccaagaaagtctcccgcgtgcaggtggtctcctctcttcaatctagtgttgtggaagcttttaataaggtgctcagctctgtcaaccccgtaccggtatatatccctaacctgagtccccctgcgaacgctggaattaccctgcccaccagagggtataagtgtctcgaatgtggcgattccttcgccctcgagaagtcactgactcagcattacgacaggagaagtgttagaatcgaagtgacatgcaaccattgcacaaaaaatttagtcttctacaataagtgcagcctcttgagtcatgcacggggtcacaaggagaagggcgtggtaatgcaatgtagtcacctaattctcaaacccgtgccagctgaccagatgatcgttagcccgtcgagcaacacttctactagcacctccacactgcaaagccccgtgggagctggcacacatacggtgaccaaaatccagagcggcatcactggtaccgtgatttccgccccttcgtctactcccatcactccagccatgcccctcgatgaggatccgtcaaaattatgtcgccattctttgaagtgtctggaatgcaatgaagttttccaagacgagacatccctcgcgacccacttccaacaggccgcagatacctcaggacagaagacttgcaccatctgccagatgctcctgcccaaccagtgctcgtatgcctctcatcagcggattcatcagcacaagagtccttacacttgtcccgaatgcggggcaatctgccggtcagtacacttccagacccacgtcacaaaaaactgcctccactacactcggcgagtgggcttcagatgtgtgcactgcaacgtggtctactccgatgtggctgccttgaaatcccacatacagggatctcactgtgaggtcttttacaaatgtccaatttgtccgatggcgttcaaaagcgctccctctacgcacagtcacgcctacactcagcaccctggtatcaaaattggagaacccaagatcatctacaaatgctccatgtgcgacacagtctttaccctccaaaccctgctctatagacactttgatcagcacattgagaatcagaaagtcagcgttttcaagtgcccagactgttctttgctctatgcccaaaaacagctcatgatggaccacattaagtctatgcacggaacactgaagagcattgaaggtcccccaaatcttgggattaacctcccactgtccattaaacctgccacgcagaactcagctaaccagaacaaggaagacaccaagtctatgaacgggaaggagaagcttgagaaaaaatccccctctcccgttaaaaagtctatggaaactaagaaagtcgcatcccccggttggacctgctgggaatgtgattgtctgtttatgcaacgtgacgtgtatattagtcacgtccgaaaagagcacggtaagcagatgaagaagcatccatgtcgccagtgcgacaagagtttcagcagctctcatagcctgtgtcgccataatcggataaaacataaggggataagaaaggtgtacgcgtgctcgcattgcccggacagccgtaggaccttcaccaagcgcctcatgctggagaagcacgtccagctgatgcatgggatcaaagaccctgatctcaaagagatgactgatgcaaccaacgaggaggagactgagatcaaggaggataccaaagtgccaagtcccaagcggaaattagaggagccggtgctggaattccggcctcctcgaggggcaattactcaaccgctgaaaaaacttaaaattaacgtctttaaagtccataaatgcgctgtatgtggatttacaaccgaaaacttgttgcagttccacgaacacataccccagcacaaaagtgatggatcttcctatcagtgccgcgaatgcggtctctgttatacaagtcacgtctccctcagcagacacctgttcattgttcataagctgaaagagcctcagccagtgtcaaagcagaatggagccggagaagataaccagcaggagaataaaccaagccacgaggatgaatcaccagacggcgctgttagcgaccgcaaatgcaaggtctgcgctaaaaccttcgagacagaggcggctctgaatacccacatgcggacgcacggaatggcctttattaagtccaagaggatgtcttccgcagagaaatag

SEQ ID NO: 25447 - DNA, 582 bp, Artificial Sequence
  Description of Artificial Sequence: Synthetic coding sequence
atggccctgactcagggccagttaagtttttccgacgtggcaatcgaatttagtcaagaagaatggaagtgcctcgatccaggacagaaggctctgtatcgcgacgttatgctggaaaactaccgaaacctggtgtctctgggtatttgcctgcctgacctgtccgttacctccatgctagagcagaaacgcgacccctggacgctgcagtccgaagttaaaatcatcaataatcccgacgggagagaatgtatcaaaggggtgaacacagacttttcacttttggcatgggacgcccgagtgtttcgggtcgaggcctggcgggctagcggcggagcagaagagccaaccggcccaaatttcgttggcaatgactccccactgcccagtcccctggccctgctaccttttcccagcgtttccgcaagtctgggagatgccaaaagggctagactgactgctgaaggaagagggcacggaacacttagagcaggtcctgctccacggccacgctctgctgcacctcacgctcctgatgcagtacaaaggtggccccctgagcagaggctacctcgtagctag

SEQ ID NO: 25448 - DNA, 2025 bp, Artificial Sequence
  Description of Artificial Sequence: Synthetic coding sequence
atggccctaacccagggacagctgagcttttcagatgtggccattgaatttagtcaggaagaatggaaatgtctggatcccggtcagaaggctctgtaccgcgatgtgatgttggaaaattacagaaaccttgtatcactgggggaagacaacgtccgtccggaagcctgtatttgtagtggtatctgtctaccagacctttcagtgacatccatgctagagcaaaaacgcgacccatggacacttcaaagcgaagtgaaaataataaataaccctgatgggagggaatgcattaagggggtgaacacagaaaagtcgtcaaaactggggtcatccgccggaaacaaatccctgaagaatcagcatggactaacactacagctgcatctgactgagtggcagcccttccaggctgtgcggaatatttatgggtgtaaacacgtcgagaagagtatatccgacaattcgagcgtatcaccggttcaaattagtttcttctccgttaagacacacatttttaataattaccgtaatgattttctctttagcacactgttgccacaggaacaaaaagtccacattcgggagaagccatatgggtgtaacgagcacggaaaagtgttccgggtcagtagtagcctaaccaacaggcaggtgattcatattgctgataagacgtataagtgctctgattgtggagagattttcagttccaattccaatttcgcgcaacaccaaagaatccatacaggtgagaaaccttacaaatataatgaatgcggaaaggtattcaaccagaactcgcaccttgctcaacatcagaaaatacacacaggccaaaagccatacaataataaagaatgtggtaaagtgttcagccatcatgcttaccttgcacagcaccgcaaaatccacaccggggagaagccttacaagtgtagcgagtgtggaaaagccttttcagtttgctcatcactcacggcacatctggttatccatacgggtgaaaagccttacgattgcaaggaatgtgggaaggtcttccgccataaatctagtttgactactcatcagacagttcatacaggcgagcgcccttataagtgtaacgaatgtgggaaagggtttagcagaatcgccttcctggccagacataggaaggtgcacaccggtgaaaagccatataagtgtaatgagtgcggtaaggtgttcatcggtaactccaggttagcgaggcataggaagatacataccggaggaagacggtacaaatgcaatgaatgtggcaaagcttttagaacatgctctgatctgactgcacacctattaatccacacaggcgagaagccttacgaatgcatcgactgcggaaaagtgttccgacataaaagcagcttgacttatcactgtaggatccacactggcgagaaaccatacaaatgtaacgaatgcggaaaagtctttagccagaactctaatctgcagagacaccggaagatacacactggcgaaaagttgtacaaatgtaatgagtgcgggaaagtgtttaggcaaaactctcatctcgctcagcatcgggatatccataccggtgagaaaccttattcttgcaatgagtgcgggaaagtcttcaggcgtaatagtcatctcgtgcggcacaggaatgtgcacaccggagagaagccatattcctgcaatgagtgcggcaaggtgttttcgagaaattcacaccttgctcgacatcgaaatatacacacaggagaaaagccacactcgtgcaatgagtgcgggaaagtgttttcaagaaattcccatttagcacgccacaggaagattcatacaggcgagaagctctataagtgcaacgagtgttcaaaagtgttttcccgtaatagtcgacttgcccagcaccgcaatattcatacaggggttaaaccgtacagttgcaacgaatgcgggaaagtgttttctaagaacagcatacttgtacaacactgcagtatccacaccagagagaagccatag

SEQ ID NO: 25449 - DNA, 2022 bp, Artificial Sequence
  Description of Artificial Sequence: Synthetic coding sequence
gtgctcaccacgggccagctgtcttttagcgacgtggctatcgaattctcacaggaggaatggaaatgtcttgatcccggtcagaaggccctgtacagagatgttatgctcgaaaactaccggaacctggtgtctctgggggaggataacgtgagaccggaggcctgcatctgttctgggatttgcttgccagatctctctgtgacatccatgctggaacaaaaaagagacccctggactcttcagagcgaagttaagataatcaataaccctgacggtcgtgaatgcatcaaaggtgttaataccgagaaatcttccaagctgggaagctccgcgggaaataagtctctgaaaaaccagcacggactcacactgcagctgcatcttaccgaatggcagccctttcaggcagtgagaaacatctacgggtgcaagcatgtggagaaatcgatcagcgacaatagctctgtgtcacccgtgcagatatcctttttcagtgtcaaaacacatattttcaacaattacagaaatgattttttgttctccacgctgctaccacaggaacagaaagttcacatccgcgagaagccctatgggtgtaatgaacacgggaaggtttttcgggtttcatctagcctcaccaataggcaggtgattcatatcgccgataaaacatataagtgctctgattgcggggaaattttttcttcaaattccaatttcgcccagcaccagcgtattcatacaggagaaaagccctataagtacaacgagtgcggcaaagtctttaaccagaattctcaccttgcacagcaccagaaaattcatactggccagaagccatataacaacaaagaatgtggcaaagtgttctctcatcatgcgtacctggctcagcacagaaagattcacaccggcgagaaaccttataaatgctcagaatgtggcaaagccttctcagtctgtagctccctgaccgcgcacctggtaattcacacaggggagaaaccctatgactgtaaagagtgcggtaaggtctttcgccataaatccagtctcactactcaccagacagtgcataccggagagcggccttacaaatgcaatgaatgcggcaaaggcttctccagaattgctttcctcgcacggcacagaaaagtacacactggtgaaaaaccttacaagtgtaatgagtgtggaaaagtgtttatcggcaactcccgtttagctcgccacagaaaaatccatacgggtggtagaaggtacaaatgcaatgagtgcggcaaggccttcaggacctgcagcgacctgacagctcacctactgatccacacgggggaaaagccatatgagtgcatagattgcggaaaggtgttccgccacaagagtagcctaacctatcattgtcgtatacatacaggggagaagccctacaagtgtaatgagtgcggaaaagtgtttagccagaacagcaacctacaacgacataggaaaatacatacaggagagaaactgtataagtgtaacgaatgcgggaaagtatttaggcaaaacagccaccttgcacagcatcgcgacattcatacgggagagaaaccctatagctgcaacgaatgcggcaaggtgtttaggcggaattcccacctggtgagacatcggaatgtacacaccggcgaaaaaccctacagctgcaacgagtgtggaaaagtcttttccagaaatagtcatcttgcccgtcaccggaatattcacacaggagagaagcctcacagttgtaatgagtgcggaaaagttttttcaagaaattcgcatcttgctaggcatcgaaagatacatactggcgagaaactctataaatgcaacgagtgcagtaaggtgtttagccggaattccagactggcccaacataggaacattcacacaggagtgaagccttattcttgtaatgagtgtgggaaggtcttttcaaaaaactccatccttgttcagcattgtagcatccacacaagagaaaagccctag

SEQ ID NO: 25450 - DNA, 453 bp, Artificial Sequence
  Description of Artificial Sequence: Synthetic coding sequence
atggccctcacccagggtcagttgtcattctccgacgtggcgatcgagttcagccaggaagagtggaaatgcctcgacccaggtcagaaagcactgtatcgggatgttatgctagaaaattacaggaatctggtgagccttgatttttctctcctcgcctgggatgcgagagtgttccgggttgaggcttggagggcttctggcggagccgaggaaccaaccgggcctaacttcgtgggcaacgattcacccctgcccagtcccctggctttgttaccctttccctctgtctctgcctctttaggcgacgccaagagggctcggcttacggcagaaggccgtggccacggaacactgcgggctggccctgcgcctaggcccagatctgcagccccacacgcccctgatgcagtgcagagatggcctccagagcagcggctgcctcgctcatag

SEQ ID NO: 25451 - DNA, 1986 bp, Artificial Sequence
  Description of Artificial Sequence: Synthetic coding sequence
atggccttaacacaaggtcagttgtccttctccgatgttgcgattgagttcagtcaggaggagtggaagtgcctggaccctggccagaaggcattgtatcgggatgtgatgctggaaaactaccgtaatctggtgtcactcggaatatgcttgcccgatttgtctgtcacatctatgctagagcagaaaagggacccttggacgcttcagagtgaggtgaaaataatcaataatcctgatgggagagaatgcattaagggtgtgaataccgagaaatccagtaaactgggctccagcgccggtaataagagcctaaaaaatcagcacggccttacactgcaactccacctcaccgagtggcagccctttcaggccgtgcgcaatatctatggatgtaagcatgtcgagaagtctatctcagataatagctcagtcagccccgtccagatttccttcttttcggtaaagacccatatcttcaacaactacaggaatgattttcttttcagcactctcttaccccaggaacagaaagtgcacatcagagaaaagccgtacgggtgcaacgagcatggcaaggtttttcgggtgagttcctctctgaccaatagacaagtcatacacatcgccgacaagacctacaaatgctctgattgcggcgagatattctccagcaatagcaattttgcccagcaccagcgcatccacaccggcgaaaaaccatacaagtacaatgagtgtgggaaagtgtttaatcagaactcccatttggctcagcaccagaagattcatacaggacaaaagccatataataacaaagagtgcgggaaggtcttcagccatcacgcatacctggctcagcatcggaagatacacacgggagaaaaaccctataaatgcagcgagtgtgggaaggccttttccgtgtgtagctccctcaccgcccacctggttattcatactggtgaaaagccctacgactgtaaggaatgcggtaaggtttttagacataaatcctctctgactactcaccagacggtgcataccggtgaacgaccctacaaatgcaatgagtgcggtaaggggttttcacgtatcgctttcctggcccgacatcggaaggtgcacactggcgagaagccttataaatgtaatgagtgtgggaaagtttttattggcaattccaggctcgccagacatcgtaagatccacacaggaggaaggaggtataaatgtaacgagtgtgggaaagcgttccgcacctgtagcgacctgacagctcacctgctcatccatactggagagaagccctacgagtgcatagactgtggtaaagtcttcaggcacaagagtagcctaacctaccactgccgcatccacacaggggaaaaaccttacaagtgtaacgagtgcggcaaagtgttttcacagaactcaaatttgcaacgccacagaaagattcacactggagaaaaattatacaagtgcaacgagtgcgggaaggtgttcaggcaaaacagccacctggcccagcacagggatatccataccggggagaagccctactcctgtaatgaatgtgggaaggtattccggaggaactcacatctggtaagacatcgcaatgtgcataccggcgaaaagccctacagttgcaacgaatgcggtaaggtgttctctcgaaattctcatctcgccagacacagaaatatccacacgggcgagaagcctcacagttgcaacgaatgtgggaaagtgttctcgcgaaacagccatcttgctaggcaccgcaaaatacacacgggggaaaaactgtacaagtgtaatgagtgtagtaaggttttttcacgtaattctagactcgcacagcacaggaatatccacactggggtaaagccctattcttgcaacgagtgcggaaaggtattctctaagaattcaattctcgtccagcactgtagtattcataccagagaaaagccatag

SEQ ID NO: 25452 - DNA, 3903 bp, Artificial Sequence
  Description of Artificial Sequence: Synthetic coding sequence
atggaggaggctagtctgtgcttaggagtatcttctgccgagccagaggccgagcctcacctctctggacctgttttgaatggacagtacgcgatgtcgcagaagttgcaccagatcacatcacaactctctcacgcattcccagagttgcatcccagacctaatcccgaagagaaaccacctgcttcactggaggagaaggcacatgtacccatgagcgggcagccaatgggatcccagatggccctgctcgcgaaccagctgggcagagaggtagatacaagcctcaacggtagggtggacctccagcaattcctgaacggccaaaacctgggcatcatgagccaaatgtccgacattgaggacgacgccagaaaaaatcggaaatacccttgccctctgtgtgggaagagatttagattcaatagtatattaagtcttcatatgaggacccatactggggaaaaaccattcaaatgcccttattgcgatcatagagcagcacagaaaggcaacctaaagatccaccttagaacccacaaactggggaacctgggcaaagggcgtggacgggtacgggaggaaaataggctgttacatgagcttgaagaacgcgcaatcctccgcgacaaacaactgaagggctccctgcttcagccgcgtccagatttgaagcctcctccccatgcccagcaagcccctctggctgcctgtacactggccctgcaagcgaatcatagcgtgcctgacgtcgcccaccctgtgccgtcaccaaaacccgcaagcgtgcaggaggacgccgtcgcacccgcagcaggctttcgatgcaccttttgcaaggggaaattcaagaaacgcgaggaactagatcggcacatcagaatcctgcataaaccgtacaaatgcacactgtgtgacttcgccgctagccaggaagaggaacttatctcacacgtcgagaaagcccatatcaccgctgaatccgcacagggacaggggcctaatgggggaggggagcagagcgcgaatgaatttcggtgtgaagtgtgcggccaggttttttctcaggcttggttcctcaagggccatatgcgcaagcataaagacagcttcgaacactgctgtcaaatttgcggcagaaggttcaaggagccttggttcctcaaaaaccacatgaaggtccacctgaataagctgtcggtgaagaacaagagcccttccgatcccgaggtccctgttcccatgggtggtatgtctcaagaagcccacgcaaatctgtattctcggtacttgtcttgtctgcagtcaggtttcatgacgccagataaagccggactgtcagaaccatcccagttatacggaaaaggagagttaccaatgaaagagaaggaagcgctggggaagctacttagccctatttcaagtatggcccatggtgtgcctgaaggcgataaacactccctgctgggctgcctgaacttagtgcctcctctgaagagtagttgtatcgagaggctgcaagccgcagcaaaggccgctgaaatggacccagtcaattcttaccaggcctggcagcttatggccaggggcatggccatggaacatgggtttctgtcaaaagagcatcccctccagaggaaccatgaggacactctggctaacgcaggagtgcttttcgacaaggaaaagcgggagtatgttctcgtgggagcggacggctccaaacagaagatgccagccgacctcgttcacagtacaaaggtgggaagccagcgggatttgccctcaaaactcgacccactggagtcatctagagatttcctttcccacgggctaaatcagacactggaatacaatctgcaaggacccggaaatatgaaggagaagcccacagagtgtcctgactgcggccgtgtgtttagaacctaccatcaagtggtggttcatagtcgggtccataagcgcgatcggaaaggcgaggaagatggcttgcacgtcggactggatgagaggaggggcagcggcagcgatcaggaaagccaatctgtgagccgctcgacaacgccagggtcctccaacgttacagaagaaagcggcgtgggagggggtttaagtcaaaccggttctgcacaggaggatagcccccaccctagctcaccgagctccagtgacatcggcgaagaggccggtagatctgctggcgtccagcagccagcacttctccgagaccgaagcctgggttcagctatgaaggactgtccttattgcggaaaaacatttagaacatctcatcatcttaaagttcacctgaggatccacacgggagaaaagccgtacaagtgcccacattgcgattatgccggaactcaatccgcttctctgaaatatcatttagaacgccatcacagggaacgccagaacggagccggtcccttgtccgggcagccccctaatcaggaccacaaggacgagatgtcctctaaggcgagcctgtttatccgccctgatattctaaggggagcctttaagggccttccaggcatagattttcgcggtggccctgcttctcaacagtggacaagtggcgtgctatcctctggcgaccactcaggccaggcgactggaatgtcatccgaggttccctcagacgccttgaagggtactgaccttccgtccaaatccacccacttctcagaaatagggagagcgtatcaatctattgtgtccaatggagttaactttcaggggtccctccaggctttcatggactcttttgtgctgtccagcctgaagaaggagaaggacatgaaagataaggccctagccgatccgcctagtatgaaggtccacggtgtggacggcggagaggaaaagccaagtggaaaatctagccagcgcaagagcgagaagagccagtacgagccgcttgatctgagcgtccgccctgacgcagcgagtttgcccggaagcagtgtgactgtacaggattctatcgcttggcatggatgccttttctgcgcttttacgacatcatctatggagctcatggcactgcacctacaggccaatcatctgggaaaagcaaagcgaaaagataacaccattggagtgaccgtaaattgcaaggatcaagccagggaggcttctaaaatggcattgctccccagtctccagagcaacaaagatcttggactgagcaatatgatctccagtcttgactcagccagcgagaaaatggcccaggggcagctcaaggaaacactcggggagcagaagagcggagcctggactggccatgtggacccagctttctgtaacttcccaagcgatttctacaaacagttcggggtctacccaggcatggtcggctccggtgctagttcctcctgccctaacaaggaacccgatggtaaagcgcatagtgaagaagatgtgccaatactcattccagaaaccacctcgaagaacacgaccgatgacctgtccgatatcgcttcaagtgaagacatggacagctccaagggcgaaaacaatgatgaggaagatgtggagactgagcctgagatgatgactaaaccattatcagcgctttctaaagactccagcagtgacggtggagacagtctgcagcctacaggcaccagccaaccagtgcagggcctggtgtcccccctgagtcaggccccagagaaacagtggcactcgcaaggactcttacaggcccaggatcctctagccggtttgcctaagccggaacgtggtccgcaaagtctggataaacccatgaatatgctgtcggtgctgcgggcatatagctctgatggccttgccgcttttaacggcctcgcatcgagcactgctaacagcggttgtatcaagcgaccagatctttgcggaaagtag

SEQ ID NO: 25453 - DNA, 4098 bp, Artificial Sequence
  Description of Artificial Sequence: Synthetic coding sequence
atggatcagtatagcctcggcgacgagggggctctacccagtgagatgcacttgccttccttttctgaaagccagggtctgaattgttctgacactctcaatcgggatttaggccctaacactcggggattcctgtatgctggactgtcaggcctcgatccagatcctagtctgcctaccccagatatgtcttctgaggtcctggaagacaacctcgacactctgtccctatattctggtaaagatagcgactctgtaaagttactggaggaatatgcagactccgagagtcaggcttcgcttcaggatttaggactcggtgtgctgaaggccaaagaggccgacgagggcggaagggccactagtgggtctgccagaaaaggaaaaagacagcacagtagtccccagaatccccttcttgattgcagcctgtgtggtaaggtgttctcctccgcttccagcttatccaaacactacttaacgcattctcaggagaggaaacatgtgtgcaaaatatgtagcaaagcgttcaaacgccaggatcacctcaccggccacatgctcacacatcagaaaaccaagccattcgtatgcatagagcaaggctgttcaaagtcctactgcgactatagaagcctgcgtaggcactatgaggtacatcacggcctgtgcatcttgaaggaggccccaccagaagaggaagcgtgtggcgactccccccatgcacatgaatctgccggacagccaccaccttcttctctgcgcagcctggtgccccctgaggcaagatccccgggatcattactcccccatagagatttgctgaggagaatcgtgtccagcatcgtgcaccagaaaaccccatccccaggacccgcacctgccggtgctagtgatagcgaggggaggaacaccgcctgtccctgtccagcttcatcagggagctcctcctgtactcctgctgggcctcacgctgcccctgcagctcttgataccgagctcccggaggagccctgcctcccacagaaagaaccagctaccgacgtcttcacagcccctaattcacgtgcagcagagaacggagccccagaccctcctgagccagagcctgatacagcactgctgcaggcgcgttcaactgccgagtgttggcctgaagggggatctgttcctgcctgtctgcccctgttccggggacaaaccgtgccagcaagctctcagccatctagtcattctttccagtggttgagaaatctgcctggatgtccgaagagcaagggaaataacgtgtttgttgtacacaagcctagcgccgtcccctccagagaaggcagtgagagcggcccaggtcctagtagtgggagcccatccgaggaatccccccctggaccaggtgggggactcgaggacgccctgccatttcccgcagcactgttgagggtccctgctgaagccccttctgatcctcggagtgcatcaggggaggacgatccctgcgccccaaagaaagtgaaagttgactgtgactcattcctgtgccagaacccaggtgagcctgggctgcaggaggcacaaaaggcgggtggacttcccgctgacgctagtcctctcttcaggcagctgtttttaaaaagtcaggagccattggtttcacatgaacagatgcaggtgtttcaaatgataacaaagtcgcagaggattttttctcacgcccaagttgccgcagtctccagtcagctgcccgcaccagaaggcaagccagcagctctaagacccctccaggggccatggccccaacagccaccacctttagcccctgcggtcgacagcttacacgccggaccaggtaaccctgaggcggaaggcagtcctgctagaagacgcaaaaccacaccaggtgtccccagggaggcttctccgggtagcacccggcgtgatgccaagggagggctgaaggtggccgcagttcctaccccacttgctgctccctcattggatccttcgagaaatcccgatattagcagcctcgctaagcagctgcgtagttctaaaggaacactggacctggaagatatctttccatcaacgggtcagcgccagacgcagctgggcggtgaagaacctcccggagcttcgttaccaggtaaacaagcacccgctgaaaatggggctgctagccgaatcacaaaaggagagaaaggccctgcctgcagtcgaggcggaggatatcggcttttagggaaccctagggctcctagattttcaggatttcgaaaggagaaggcgaagatggatatgtgttgtgctgcaagtccttctcaggtagcaatggcgagcttcagttccgccggaccacctgctgatccaagcaagtctaagctcacgatcttttctaggatccagggtggcaacatctatcgcctgccccacccagttaaggaggaaaacgttgccggtcgcggaaatcaacagaacggatccccaacagattggacaaagccccgttcaactttcgtatgcaaaaattgcagccagatgttctacacggaaaaaggtttgtcctctcacatgtgctttcattctgaccaatggccctccccacgagggaagcaagagcctcaggtgtttgggacagagttttgcaaaccattgcggcaggtactgagacctgagggcgaccggcattccccacctgggactaaaaagcctcttgaccccactgccgctgccccattggttgtgccacaatcaatccccgtggtgcccgttactcggcatattggcagcatggccatgatggaatggtgcagtaggtggttacaggcgacaacctgcggcagtaagctcctgcaaggacaggaaaaagatggcgaggaacgagactcgaaggaatccagccaacaaagaaaacgtaagaagagacctcccccttctacggccggagagcctggtcccgcaggctgccatcaatcccggctgcgaagcccgatgttcttagtcgactgcctgctcaaagggctatttcaatgcagtccctacacccctccaccgatgttgtctcctattagggaaggttcaggtgtttatttcaataccttgtgctccacatcaactcaggcaagccccgaccagcttatcagctctatgctggatcaggtggatggaagctttggaatctgcgtcgtgaaggacgacaccaaaatttccatcgagccacatatcaatataggttcccggtttcaagccgaaatccctgaacttcaggagagatctcttgctgggacagacgagcatgtggcaagtctggtgtggaagccctggggagacatgatgataagttcggagactcaggacagagtcaccgaactttgcaacgtggcatgctctagtgtcatgccaggtggcggaactaacctcgagctcgcgttacattgcctgcacgaggcccaggggaatgtgcaggtcgctctggaaacactgctcctccgcggacctcacaagcctcgaacccaccttttggcggattacaggtacacgggatccgacgtatggacacctatagagaagcgactcttcaaaaaggcgttctatgctcacaagaaagacttttacctcatacacaagatgattcagacgaagactgtggcgcagtgtgtcgagtactactacatctggaaaaagatgatcaagttcgactgtgggagggctcctggactggagaagagagttaaaagagagcccgaagaggttgaaagaactgaggagaaagttccgtgcagcccgcgagagcggccatcccaccatccaacaccaaagctgaaaaccaaatcatatcggcgagaaagtatattaagctcttccccgaacgctggaagtaagcggacacccgaattgctgggctccgccgaaagtcaaggaatctttccctgccgagaatgcgaacgggtatttgacaaaatcaaatcccggaacgcacacatgaagaggcataggctgcaagatcacgtcgagccgatcattagagtgaagtggcctgtcaagccattccaacttaaagaggaagagctgggagctgacatcggtcccctacagtggtag

SEQ ID NO: 25454 - DNA, 3267 bp, Artificial Sequence
  Description of Artificial Sequence: Synthetic coding sequence
atggaccaatacagcctaggagacgagggagccctccctagcgaaatgcacctcccgagtttcagtgagtcccaggggctgaattgttccgacaccttgaatagggacctgggtccaaatacacgaggattcctatatgcgggactcagtggtctagaccctgacccctcacttcctacccccgatatgagctcagaggtgctcgaagataatttagataccctgtcactgtacagtggcaaggattctgacagtgtcaaactgctggaagagtacgccgactctgagagtcaggcatcactgcaggatctggggctaggcgtgctcaaagccaaggaggccgatgagggtggtagggcaaccagcggttccgcaagaaaggggaagaggcagcatagttcaccacagaaccctctcctggattgttcactgtgcggtaaggtcttctcttccgcatcttccttatcaaagcactatttaacccacagccaggagaggaagcatgtatgcaagatctgcagcaaggcctttaaacgacaggaccaccttaccgggcatatgctcacccaccagaagaccaaaccgttcgtgtgcattgagcaaggctgctcgaaatcatactgtgattacaggtctctgcgcaggcactatgaagttcaccatgggctctgtattctgaaggaggccccacctgaggaagaagcgtgtggcgacagcccacatgctcacgagtcggccggacagccacccccttcctcccttagaagtttggttcctcctgaggcacggagtcccggatctctcctgcctcacagagatctgctgcggaggatagtgtctagtattgtgcaccagaagacccctagccccggacccgctcccgctggcgcttcggacagcgaaggccgaaacacagcctgcccctgtccagccagtagcggcagtagctcttgcacacccgctggccctcatgctgctccagcagccttggacaccgaactgcccgaagagccttgcctccctcagaaagagccagcaactgacgtcttcacagcccctaattcccgagccgctgagaatggggctcccgacccaccagaaccagaaccagataccgccctcctgcaggccagaagtacggccgagtgttggcccgaaggaggttcggtaccagcgtgtctaccccttttcagaggacagaccgtcccggcaagctctcaaccctcgagccacagctttcagtggttgagaaacctgcccggttgtcctaagtccaagggtaacaatgtctttgtcgtgcacaagccatcggcggtgccatcacgggaagggagcgagagtgggccagggccttcttctggcagtccttccgaagagtctcctcccggtcctgggggaggcctggaagacgccctcccatttccagctgccttgttacgagtcccagccgaggccccaagtgatcccaggtctgctagcggtgaggacgacccctgtgcacccaaaaaggtaaaggtagattgtgactccttcctatgccaaaatcccggagagcccggtttacaggaggcccagaaggccggtggactgccagccgatgcctctcctctgtttaggcagctgtttctaaaatctcaggaacctctcgtgtcccacgagcagatgcaggtcttccaaatgatcacaaagagccagcgcatattctctcacgcccaggtggccgctgtgagctcccaactaccagcacctgaaggtaagcctgccgctttgcggcctctgcaaggaccctggcctcagcagcctccacctcttgcacctgcagttgacagccttcatgccggaccgggaaatccagaggctgaaggatctccagccagacgcaggaaaactacgcccggagtcccacgagaagcctctccgggaagcacccggcgagatgctaagggtggtctcaaagtggccgctgtcccaacgcccctggccgcaccctcacttgatcctagtaggaatccagacatcagctctctggcaaagcagttgcgcagctctaagggtacgctcgacttagaggacatcttcccctccacggggcagcgccagacccaattggggggagaagaacccccaggagcaagcctgccagggaagcaggcgcctgccgaaaatggagccgcaagccggatcaccaagggagagaaagggccagcatgtagccggggaggcggttaccggctgctcggtaatccacgcgcacctcgcttctccgggttcaggaaggagaaagcaaagatggacatgtgttgtgctgcctcaccctctcaagtggccatggctagtttctccagcgctggtccacctgcggatcccagcaaatcaaagctcaccatttttagccgcatccagggcggaaacatttatagactgccacaccctgtgaaggaagagaacgtcgctggtaggggaaatcagcagaacggatcacccacagactggactaagcccagaagcacctttgtgtgcaaaaactgtagccagatgttttacactgagaagggtctgtcttctcacatgtgcttccattccgaccaatggcctagtcctcgaggcaagcaagaacctcaggtctttggcacagaattttgcaagccattgaggcaggttctgaggccggagggcgaccggcatagccctcccggaaccaagaagccgctagaccccacagccgctgcccctctcgttgtgccccagagcattcctgtggtgcctgtgactagacacattggctctatggccatgatccaaaccaagacagtcgcacagtgtgtcgagtattattatatctggaagaagatgattaagtttgattgcggcagagcccctggactggagaagcgtgtgaaacgcgaaccagaggaggtcgagaggactgaagaaaaggtcccttgtagcccccgtgaaagaccatctcatcaccctaccccaaagcttaagaccaagagctataggcgggagagtatcttgtcctcaagcccaaacgccggatccaagcggacccccgaacttttaggatcagcggagtcgcagggcatattcccatgcagagagtgcgagcgggtcttcgacaagatcaaaagccgtaacgcccatatgaaacgacaccggttgcaggatcacgtcgagcctataatccgcgttaagtggcccgttaagcccttccagctgaaagaagaggagctgggagccgacattggtccgctacagtggtag

SEQ ID NO: 25455 - DNA, 1803 bp, Artificial Sequence
  Description of Artificial Sequence: Synthetic coding sequence
atggcagctagtgcacaggtcagcgtgacgttcgaagatgttgccgtaacatttactcaagaagagtggggtcaactggatgccgcacaaaggacactgtaccaggaagtgatgctggaaacctgtggactactgatgagtctgggctgtccgcttttcaagcccgagctgatctaccagctggatcataggcaggagctgtggatggctaccaaagacctatcacagagctcatatcccggtgataatactaaacccaagacgaccgaacccactttttcacatctcgccctgccagaagaggtcctactccaagaacagttgacacaaggggcttcaaagaactctcagctcgggcagtcgaaggatcaagatggacccagcgaaatgcaggaggtccatctgaagatcggaatcggtcctcagcggggtaaactgcttgagaagatgtctagcgaaagggacggattggggtctgatgacggggtctgtactaaaattactcaaaaacaggtcagcacagaaggtgatctgtatgaatgtgatagtcacggcccagtgactgacgcactgatccgggaggagaagaattcatacaagtgcgaggagtgtgggaaagtatttaagaaaaacgctctcctggttcagcacgaacgaatccacactcaggttaaaccctacgaatgcaccgaatgcggaaaaacattcagtaagtcaacccacctactccagcatctaatcatccatactggggagaagccgtacaaatgcatggagtgtggcaaggcctttaatagaagaagtcatttaacccgccaccagcggatccatagtggcgagaaaccctacaagtgcagtgagtgcgggaaagccttcactcatcggtccaccttcgtgttacaccaccggtctcacaccggtgagaagccttttgtttgcaaagagtgcggaaaagcttttcgtgatagacctggtttcattcggcactacataatccataccggagagaagccttatgaatgtatagagtgtggaaaagccttcaataggcggagctacctgacctggcaccagcagattcacactggggtgaagccatttgaatgcaacgaatgcggcaaggcattttgcgagtctgctgaccttattcagcattatatcattcacactggagaaaagccctacaaatgcatggagtgtggcaaggcgttcaacagacgctctcacttaaaacagcatcagaggatccacactggtgagaaaccttacgaatgtagtgaatgcggaaaggcatttacacactgtagcacttttgtgcttcataaacggacccacactggagaaaagccatatgagtgtaaggagtgcggcaaagctttctcagaccgagctgatttgattaggcatttctccatccataccggggaaaaaccctatgagtgtgtcgaatgtggaaaggcttttaaccgatcttctcacctgactcgccatcagcaaatccatactggggagaagccatatgagtgtatccaatgcggaaaggccttctgtcgctccgccaacctcatcaggcactccattattcacacgggggagaagccttatgaatgtagcgaatgcggtaaggccttcaaccgtggatccagcttaactcaccatcagcgaattcacaccggcagaaacccaaccatcgtcaccgacgtagggcgaccctttatgacagcccagacatctgtgaatatccaggagctgttactgggtaaagagtttctaaacatcactacggaggaaaatctctggtag

SEQ ID NO: 25456 - DNA, 2148 bp, Artificial Sequence
  Description of Artificial Sequence: Synthetic coding sequence
atggaagcccgttccatgctcgtgccccctcaggctagtgtatgtttcgaggacgtcgcgatggcattcacgcaggaagagtgggagcaactggacttagcacagagaacattatacagggaagtgactctggaaacctgggaacacattgtaagcttgggcttgtttttgtcgaagtctgatgtcatctctcagcttgaacaggaagaggacctgtgtcgggctgagcaagaagcaccccgtgactggaaagcaactttggaagaaaaccgactcaattccgagaaagatcgggcaagggaggaactatcacaccatgttgaggtctatagatcaggcccagaagaacccccttcactcgttctcgggaaggtgcaggaccagtcaaaccagctacgtgagcaccaggagaactcactcaggtttatggtgcttacctccgaacggctgttcgctcagcgcgagcactgcgagttggagcttgggggaggctacagcttgccttccacactttctttgctgccaaccaccctccccaccagcactggctttcctaagcctaattcccaggtcaaagaattaaaacagaatagtgcattcattaatcacgaaaaaaacggagctgatggcaagcattgcgagtcacaccagtgtgcgcgtgccttttgtcagtcaatctacctgtctaaacttggcaatgtagaaaccggcaagaagaatccctacgagtacatagtttctggtgactctctgaactacgggagctccctttgcttccacggtaggacattctcagtcaaaaaatccgatgattgtaaagactatgggaacctcttcagtcacagcgtgtcccttaacgagcagaagcccgtgcacttcggaaagagccagtatgagtgcgacgaatgtcgggagacttgctccgaatctctgtgtctggtgcagacagaacggtccggaccaggcgagacccccttccggtgcgaagagaggtgcgccgcttttccaatggcctcaagcttcagcgattgcaatataatccaaaccaccgagaagccttcagtgtgtaaccaatgtggtaagagcttctcttgctgcaagcttatccaccagagaacacacacaggcgaaaagccctttgagtgcactcagtgtggaaaatctttttctcagagctacgatctggtgattcatcagcgcacccacaccggagagaagccctatgagtgtgacctgtgcgggaagtccttcacgcaaagaagcaaactaattacccaccaacggattcatacaggggagaaaccttaccagtgcatagaatgccggaagtcctttcgttggaattctaatctcattgtacaccagagaatccataccggcgagaaaccttacgagtgtactcactgcggtaaatcgttctctcagagttatgaactggtcactcacaagaggacgcacacgggggagaagccattcaaatgcacacaatgtgggaagagctttagccagaagtacgatctggttgtgcaccagaggacccacacaggagagaagccctacgaatgcaacttatgcggaaaatccttcagccaaagttctaagttgatcactcaccagaggattcatacaggggaaaagccctatcagtgcattgaatgcggcaagagcttccgctggaacagcaatctcgttatacaccagcggatccacaccggggagaagccttacgactgcacacactgcggaaagagttttagccagtcataccagctcgttgctcacaagcggacccatacgggcgaaaaaccatacgagtgtaacgagtgtggaaaagctttcaaccgttctacacagctaattagacacctacagattcataccggggagaagccctataagtgcaatcagtgcaacaaggctttcgcaaggtcaagttatttggtaatgcaccagcgaacacacacaggcgagaagcctttcgagtgtagtcaatgcggcaaggccttttcaggctcctccaatctgctgtcccaccatcgcatacacagtggggagaagccttatgaatgctccgattgcggaaagtcctttagacagcaatctcagctggtggtccatcgaaggactcatactggtgagaagccgtag

SEQ ID NO: 25457 - DNA, 321 bp, Artificial Sequence
  Description of Artificial Sequence: Synthetic coding sequence
atggaagctaggtcaatgctcgttccgccacaggcctcagtgtgtttcgaggacgttgctatggccttcactcaggaggagtgggaacagcttgatctagcccagcgaacgctctaccgcgaggtcaccttagaaacctgggaacacatcgtgagcttagggctgttcttatcaaagtccgatgtcatctctcagctcgagcaagaagaagacctttgtagggccgagcaggaggcacccagaggaacaagtgggctgagccaggtaactggcgttgttgctgatggcagcttcaggtttcccgtgtgggactttacttag

SEQ ID NO: 25458 - DNA, 2064 bp, Artificial Sequence
  Description of Artificial Sequence: Synthetic coding sequence
atggaggcgcgaagcatgctggtgccaccacaggcctccgtgtgtttcgaggatgtggcgatggcgtttacgcaggaggagtgggagcaactcgacctggcccagaggacgctgtaccgggaggtgacactcgaaacctgggagcacatcgtttccctggattggaaggccaccttagaagagaaccggttaaattcagagaaagatcgtgcccgtgaggaactctcacaccacgtcgaggtctaccgatcaggaccagaggagcctccgtcccttgtcctgggaaaggtgcaggaccaatctaaccaattgagggagcaccaggaaaatagtctccgctttatggtactaacctccgagcgccttttcgcacaaagagagcattgtgaactggaactgggcggaggttacagccttcctagcaccttatctctgttacccacaacattgcccacatccactgggtttccaaaaccgaattcccaggtcaaagagctcaagcagaacagcgcctttatcaaccatgaaaaaaacggcgcagacggaaaacactgtgagtctcaccagtgtgctcgagcattctgtcagtccatttatctctcgaaactgggcaatgttgagaccggaaaaaaaaacccttacgagtacatagtatcaggagattccctgaattatggcagctctttatgctttcacggtcggactttctcagtgaaaaaaagcgacgattgtaaagactatggtaatttattctcccattctgtgtccctgaatgagcagaaacctgtgcatttcggaaaaagccagtatgagtgcgatgaatgccgcgaaacctgcagtgagtccctgtgcctagtccagaccgagcgttccggccctggtgagactccctttcgctgcgaagaaagatgcgctgcgttccccatggcctcgagtttttctgattgtaatataattcagacaaccgagaaaccatcagtgtgcaaccagtgtggcaaaagtttttcatgctgcaaattgatccaccagcggactcacacgggagagaagcctttcgaatgtacgcagtgcggaaagtcctttagtcagtcctatgacctggtaatccatcagcgcacgcacacaggcgagaagccatatgagtgcgatctgtgcggaaaatcgtttacacagcgatccaaactgataacccaccagcggatccacacaggcgaaaaaccatatcagtgcatcgaatgccgtaagagcttccggtggaatagcaatctgatcgtgcaccagcggatccataccggagagaagccctacgaatgtacccactgtggcaaatccttctctcagtcgtatgagcttgtcactcacaaaaggacacacacaggagaaaagccatttaagtgcacccagtgcggtaaatccttctcgcagaaatatgacctagtagtacaccagcgtactcacacaggcgagaagccatacgagtgcaacttgtgcgggaaatcattctctcagtcttccaagttaattactcatcagcgcatccatacaggagagaaaccttatcagtgcatcgagtgcggcaaatcctttaggtggaactctaacctcgtcatacatcagcgcatccacactggcgagaaaccttacgactgtacccactgcggaaagtcattctcacagtcatatcagctcgtcgctcacaagaggacccacactggagagaaaccgtacgaatgcaacgagtgcgggaaagccttcaaccgatctacacagctgattaggcacctgcagatccacactggcgaaaagccctacaagtgcaatcagtgcaataaggcctttgcaagaagctcatacctggtgatgcaccagagaacgcatacaggcgagaagcccttcgagtgttcccagtgcggcaaagccttttcaggctcctccaatcttctgagccatcaccggatccacagcggcgagaaaccatacgagtgttccgactgtgggaaatccttccgtcaacagagtcaattagttgtgcaccggagaacacacactggggagaaaccgtag

SEQ ID NO: 25459 - DNA, 804 bp, Artificial Sequence
  Description of Artificial Sequence: Synthetic coding sequence
atggcctcgtccttttcagactgtaatatcatccagacgacagagaagccgagtgtgtgtaaccagtgcggtaaaagtttctcgtgctgcaagctgattcatcaaagaacacatacaggcgaaaaaccttttgaatgtacccagtgtggcaagtcctttagccagagctacgatttagtcatccaccagcggactcacaccggcgagaagccctacgagtgcgacctgtgcggaaaaagctttactcaaaggtccaagctcatcacccaccagagaattcatactggcgagaagccctatcaatgtattgagtgtaggaaatcgttcaggtggaactccaacctcatcgtgcatcagagaatccatacaggggagaaaccttacgaatgtacacactgtggtaagtccttttcccagtcatacgaactagtagctcataaaaggactcacaccggagaaaagccctacgaatgcaacgaatgcgggaaggcctttaatagatccacacaactgattcggcacttgcaaatccacactggagaaaaaccgtacaagtgtaatcagtgtaacaaggcctttgcgagatcttcctacttagtgatgcaccagcgcacacatactggagagaaaccctttgagtgctcccagtgcggcaaggctttctctggctcctccaacttactcagtcatcataggatacacagtggcgaaaagccatatgagtgttctgactgtggcaagagctttcggcagcagtcccagctagtggtgcacaggcgtactcatacaggtgagaaaccctag

SEQ ID NO: 25460 - DNA, 2511 bp, Artificial Sequence
  Description of Artificial Sequence: Synthetic coding sequence
atgcaggtggaccctcccctacatggaccacctaatgatttcctgatatttcagatcatccctctccactcgctgagtatcatgcctcggttcctgtggatcctgtgcttttccatggaggaaacgcagggagaactgacatccagttgcggaagtaaaaccatggcaaacgtgtccttggcttttagggatgtttccatcgacctatctcaggaggaatgggagtgtttagacgctgtgcagcgcgacttgtacaaagacgtgatgctcgaaaattactctaaccttgtgagtcttgggtacaccataccaaagccggatgtaataacactgctcgagcaggagaaggaaccctggattgtcatgagggagggaactaggaattggttcactgatcttgaatacaaatatataactaaaaatctgctgtcggagaaaaatgtgtgcaaaatatatctgtcccagctgcagaccggagaaaaatcaaagaacactattcacgaggacaccatctttcgtaatggactacaatgcaaacatgagttcgaacgccaggaacgacaccagatgggctgcgtgagtcagatgctgatccagaaacaaatctctcacccactgcaccccaaaattcacgcgcgagagaagagctacgaatgtaaggaatgtagaaaagccttcaggcagcagtcctatctcatccagcatctacggatccacaccggtgagaggccatataaatgcatggagtgcgggaaggctttttgccgagttggcgatttgcgggtgcaccatacaattcatgccggagagagaccgtatgagtgcaaagagtgtggtaaggctttcagactacactaccatcttacggagcaccaacgcatccatagtggcgtaaaaccatacgagtgcaaggagtgcggcaaggcctttagtcgagttcgggatctgagggtccatcagactattcatgcaggagagcgcccatatgagtgtaaggagtgcggcaaggcattccggctgcactatcagctgacagagcatcagaggatccacactggagagaggccctacgaatgcaaagtttgcggcaagaccttccgcgttcagcgccacatttcacaacatcagaaaatccatacgggggtgaagccatacaagtgcaacgagtgtggcaaggcttttagtcacggtagttatttggtgcagcatcagaaaattcatactggagagaaaccgtatgaatgcaaggagtgcggaaaaagcttctcatttcacgcagagttggcacgccacaggagaatccataccggcgagaagccttacgaatgtcgcgagtgtggcaaagcctttaggctgcagacagaactgactcgccaccacagaactcacactggcgagaaaccttatgagtgtaaggaatgcggcaaggcatttatatgcggctaccagttaaccctgcatctgcgcacccataccggagagattccttacgaatgtaaggaatgtggcaaaacattcagctctaggtatcatctcactcaacattataggatacacacgggggagaagccatatatttgtaacgaatgtggcaaggcctttcggctgcagggcgagttgactcggcaccacagaattcacacgtgcgaaaaaccgtacgagtgcaaagagtgcggcaaagcctttattcattcaaatcaattcattagccaccagcggatccacaccagtgaaagcacttatatttgtaaagagtgcggcaaaattttcagccggcgatataacctgactcaacatttcaagatccacactggagaaaagccttacatttgtaacgagtgcgggaaagcttttagattccagacagagctgactcagcatcatcggatacacactggcgaaaaaccctataagtgtaccgaatgcgggaaagcttttatcaggtcaactcatcttacccagcatcaccggatccacactggcgaaaagccttacgagtgtacagagtgtgggaagacattttcacggcactaccacttaactcagcaccataggggacacactggcgaaaagccgtatatatgcaacgagtgtggcaacgcgttcatttgttcttatcggctcaccctccaccagagaatccacacaggggaattaccttacgagtgtaaggagtgcgggaaaacgttcagccgcagatatcatttaacccagcacttccggctgcacacgggagagaagccttatagctgcaaggaatgtggtaatgctttcagactgcaggctgagcttacaaggcatcatatagttcatacgggcgaaaagccctataagtgtaaagaatgcggaaaagccttctctgtcaattctgaactgaccaggcaccaccgcatccacactggagagaaaccgtatcaatgcaaggaatgcggaaaggcttttattagatctgaccagctgacactccatcagcggaaccacattagtgaggaagttctgtgcataatgtag

SEQ ID NO: 25461 - DNA, 1344 bp, Artificial Sequence
  Description of Artificial Sequence: Synthetic coding sequence
aagacctttcgggtgcagaggcatatttcccagcatcagaaaatccacaccggcgtgaaaccctataaatgcaacgaatgcggaaaagccttttctcatggcagttatctggtgcagcaccaaaagattcatactggagagaaaccatacgaatgtaaagagtgcggtaaaagtttcagttttcatgcagagttggctcggcacagaaggatccataccggcgagaaaccatatgaatgcagggagtgcggcaaggccttcaggttgcaaaccgaactcactagacaccataggacccatacgggggaaaaaccctacgaatgtaaggagtgcgggaaggccttcatctgcggttaccagctgaccctccaccttagaacacatactggcgagattccttatgagtgtaaagagtgcggtaaaacattctcgagccgttaccacttaactcagcattatagaatccacaccggggagaagccgtacgaatgtaaggaatgtgggaaggctttcattcactctaaccagttcatctcccaccagaggatccatacatctgaaagtacttacatttgtaaagagtgcgggaagatctttagccgccgatacaacctcactcagcactttaagattcacaccggagaaaaaccctatatttgtaacgagtgcgggaaggcatttagattccagaccgagctgactcagcaccaccgaattcacactggggagaaaccctacaagtgcactgagtgtgggaaggcctttattcgctcaacacacctgacccaacatcatcgcattcacacaggggagaagccttacgaatgtacagagtgtggcaagacttttagccgtcactatcacttgacacagcaccacaggggacatacgggcgagaagccttacatctgcaatgaatgcggcaatgctttcatatgcagctatcgccttactctgcaccaacgcatacacacaggcgagctgccatatgaatgtaaggagtgcggaaaaaccttttcacgcagataccatctgacacagcacttcaggctgcacaccggcgaaaagccctactcttgcaaggagtgcggaaacgcgtttcgcttacaggctgagctgactaggcatcatattgtccacacgggtgaaaagccatataaatgtaaagaatgcggtaaggcatttagcgtgaatagcgaattgacaaggcatcatagaatacatacaggcgaaaaaccatatcagtgtaaagagtgcggaaaagccttcataaggagcgatcagctgacgctgcatcagagaaaccacatcagcgatagggaatttgtcatttgtaaagaatag

SEQ ID NO: 25462 - DNA, 1209 bp, Artificial Sequence
  Description of Artificial Sequence: Synthetic coding sequence
atggctgaaatgaaccctgctcagggccatgtcgtatttgaagatgtggcaatctacttctcccaggaagagtggggccatttagacgaagcccagagactgctctacagggacgtgatgctcgagaatctcgcactactgtcctccctgggttgttgtcacggcgcagaagacgaggaagcaccactggaaccgggagtgtccgttggcgtgtcccaagtgatggctccaaaaccgtgtctgtccactcagaacactcagccttgcgagacttgctcttctctgctgaaggacatcctaaggctggcagagcatgacgggactcatcccgagcaaggcttgtacacttgccctgcccatctgcatcagcatcagaaagaacagatccgggaaaagctctctcgtggagatggagggagacccacattcgttaagaatcacagagtacacatggcgggtaagacattcctctgctccgaatgcggcaaggccttcagccacaagcacaaactttctgatcatcagaaaattcataccggtgagcggacgtacaaatgcagcaaatgtggtatcctgtttatggagcggtccacactgaaccgacatcagcgcacacacacaggggaaaggccctacgaatgtaacgagtgcgggaaagcttttttgtgtaagtcccatttggtgcgacaccagacaatccactccggagagaggccctacgagtgttccgaatgcggtaaactgttcatgtggagctcaactctgatcacacaccaacgggtgcataccggaaaacgcccatatggatgcagcgaatgcgggaagttcttcaagtgcaactctaacttgtttcgccattaccgcatccataccggaaagaggtcctacggctgctccgaatgtggcaaattctttatggagcgtagtaccctgagccggcaccaacgggtccacactggtgaacgaccttacgagtgcaatgaatgcggcaagttcttttcgttgaagtctgttctcattcagcatcaacgcgtgcatacaggcgagcgcccatacgagtgtagtgaatgcgggaaggcgtttctgacaaagtcacatctgatctgccaccaaaccgtgcatacagcagctaagcaatgctccgaatgcggaaaatttttccgctacaatagtactctgctccgtcaccaaaaagtacacactggatag

SEQ ID NO: 25463 - DNA, 1065 bp, Artificial Sequence
  Description of Artificial Sequence: Synthetic coding sequence
atggccgaaatgaatcccgctcaaggccacgtggtgttcgaggacgtggccatttacttcagtcaggaagaatgggggcacttggacgaggcccagcgacttttgtatcgggacgtgatgctcgaaaacctcgcgcttctgagctctctcgggtgttgtcacggcgcagaggatgaggaagcgcctctggagcctggggtgtccgtgggagtttcacaagttatggccccaaagccatgcctctccacacagaacacccagccatgtgagacctgttcttccctgctgaaagatatcctgcgcctggcagagcatgacggaacccaccccgaacagggtctgtatacgtgccctgcccatttacaccagcaccagaaggaacaaatccgggagaagctgtcccgcggagatggcggtagacctacgtttgttaagaatcatcgagtgcacatggcgggaaaaaccttcttatgctccgagtgtgggaaggcttttagccataaacataagctgagcgaccaccaaaagattcataccggagagcgcacttacaagtgttctaaatgtggcatcctcttcatggagagatcaactttgaaccgccaccaaagaacacatactggagagcggccatatgagtgtaatgaatgcggcaaagctttcttgtgcaaatctcaccttgttagacaccagacaattcacagcggtgaaagaccttacgaatgctctgaatgtggcaagctgttcatgtggagttcgactctgatcacccaccaacgggtgcacaccggaaagcgaccttacggttgctctgaatgcggcaagtttttcaagtgcaactccaacttatttagacactataggatccataccggcaagcggtcctacgggtgcagtgaatgcggtaagttctttatggaaagatcaaccttgagccgtcaccaacgtgttcatactggtgaacgcccatacgagtgcaacgagtgcggcaaattcttttccctcaagagtgtcctgattcagcaccagcggagagtctataccgaagaagaaagcttccagtag

SEQ ID NO: 25464 - DNA, 1638 bp, Artificial Sequence
  Description of Artificial Sequence: Synthetic coding sequence
atgaacctcactgaaggtccactcgccatggctgaaatggatccaacgcaaggccgtgttgtgttcgaagatgtggcaatatatttcagccaggaggaatggggacatttggacgaagcacagagactgctgtaccgcgatgtcatgctcgaaaatctggcacttctgtctagcctgggtagctggcatggcgctgaggacgaagaagctcccagccaacaaggcttctctgtgggggtctctgaggttactgcgagcaagccatgcctcagcagccagaaagtgcacccttctgagacttgcggcccaccattgaaagatatcctatgcctggtggaacataatgggattcatcctgaacagcacatctatatctgcgaggcggaattgtttcaacaccccaagcagcaaatcggtgaaaatcttagtcgaggcgacgattggatcccatcattcgggaagaatcacagggttcacatggccgaagagattttcacttgcatggaaggatggaaagacctgcccgcaacttcctgtttgttgcagcaccagggcccacaaagtgagtggaagccgtaccgtgatacagaagaccgggaagcatttcagacggggcagaatgattacaagtgctccgaatgtggaaaaaccttcacctgctcatatagctttgtagagcatcagaagattcataccggagagaggagttatgaatgcaataaatgcggaaagttcttcaaatacagtgcgaacttcatgaagcaccaaacagtccatacatctgagcggacctatgagtgcagggaatgcggaaaaagttttatgtacaattaccgactcatgagacataagagagttcacaccggtgagcggccttatgagtgtaacacatgtggcaagttcttccgctacagctcaacctttgtacgccaccagcgcgttcacaccggtgagcggccatacgaatgcagagaatgtggtaagttttttatggacagctcaactctgattaagcaccagcgagtgcacaccggggaacgaccttacaagtgcaacgattgtgggaaattcttcaggtatatctccacattaatccggcatcagaggatccatacaggagagaggccttacgaatgtagcgtgtgcggagaattgttcaggtataactcaagtctagtgaagcactggagaaatcataccggtgaacgtccatataaatgttccgaatgcggcaagtctttcagataccactgccgcctcattagacaccagagagtgcatacaggggagcgcccatacgagtgttcagaatgcggtaaattcttccgctataactccaatcttattaagcactggcgcaatcacactggggagaggccctatgaatgtcgcgagtgtggtaaggcattctcccacaagcacatactcgtggagcaccagaagatccattcaggcgagagaccatacgaatgctctgagtgccaaaaggccttcatacgtaagtcacacctcgtgcatcatcaaaagatccacagtgaggagcgcctggtgtgttcaatgaacgtcggcaatagtcttgccaaaacacccacttctctcaatattcgcgactttacgatggaaaaggtgtaccactag

SEQ ID NO: 25465 - DNA, 1602 bp, Artificial Sequence
  Description of Artificial Sequence: Synthetic coding sequence
atgaacttgacagagggcagagtggtctttgaagatgtggcgatctatttctcccaggaggagtggggacacctggatgaagcccagaggcttctctatcgagacgttatgcttgagaatttggctcttttgtcgtctctgggaagctggcatggcgctgaggatgaggaggccccttcgcaacagggatttagtgttggcgtgtctgaggttacagccagcaagccttgcctgagcagccagaaggtccaccccagtgagacctgtggtcccccacttaaggatattctttgcctagtcgaacataacggcattcacccagagcaacacatttacatttgcgaggcggaactctttcagcatcccaaacaacagatcggcgaaaatctttctcgcggagacgactggatcccgagcttcggcaaaaaccaccgggtgcatatggccgaggagatctttacgtgcatggaggggtggaaagacctgccagctacttcgtgtctgctgcaacaccaaggccctcagtccgagtggaagccgtaccgggacacagaggaccgcgaagcgtttcagaccggccaaaatgactataaatgttcagagtgcggtaagacctttacatgctcctatagcttcgtggagcatcaaaagatccacaccggcgaacgctcctatgagtgtaacaagtgcggaaagttctttaagtactcggcgaacttcatgaagcaccagacggtccatacatcagagcgaacttacgagtgtcgggaatgtggcaaaagcttcatgtataactatcgtcttatgcggcataaacgagttcacaccggggagagaccctatgaatgtaacacatgtggtaagttctttagatacagctccacattcgtgcggcatcagcgtgtccacactggtgaaagaccatacgaatgtagagaatgtgggaaattctttatggactcttccacgctgataaagcatcaaagagtgcacactggcgagcgaccatacaaatgtaacgactgcggaaagttcttccgatacatcagtacactgattcgccaccagagaatacataccggggagaggccttacgaatgcagcgtgtgtggcgaactgttccgatataatagttccctagtgaagcactggaggaaccacacgggcgagagaccgtacaagtgtagcgagtgtggcaaatcttttcggtatcactgtaggcttattcgacaccagagggtgcatacaggcgagaggccatacgaatgttctgaatgcggtaagtttttcagatataacagcaatctgattaagcactggagaaaccacacgggagaaagaccatatgaatgccgggagtgcggcaaagcattcagccacaagcacattttagtggagcaccagaagattcactccggggagaggccttatgaatgctccgaatgccagaaggctttcatacgcaaatctcacttggtgcaccaccagaaaatacacagtgaggaacgtctggtttgctctatgaacgtcggtaattccctggccaaaacgccaacttccctgaatatcagggacttcacaatggagaaggtctaccactag

SEQ ID NO: 25466 - DNA, 1884 bp, Artificial Sequence
  Description of Artificial Sequence: Synthetic coding sequence
atggccgaggcggctcttgtcatcactccgcagggccatgtgacctttgaagatatcgccgtgtactttagccaggaggagtggggtcttctggatgaggctcagcgctgtctgtaccacgacgtgatgctggagaacttcagcctcatggccagcgtcggctgtctccatgggatcgaagcagaggaggcgccaagcgaacagaccctgagcgcgcaaggcgtctctcaggcacgaaccccaaagctcggaccctctatcccaaacgctcattcatgcgagatgtgcatcttggtcatgaaggacatcttatacctctctgaacaccagggaaccctgccgtggcagaaaccgtacacctccgtagccagcggcaagtggttttcctttggctcaaatctgcaacaacaccagaaccaagactcaggggaaaaacacatcaggaaagaggagtccagcgcactgctgctcaatagctgcaagatcccgctgagtgacaacttgttcccatgtaaagatgtcgagaaagacttcccaacaatcctaggattgttgcagcaccagaccacgcatagccgacaggagtacgcccataggagcagagagaccttccagcaacggagatataagtgcgaacaggtttttaatgaaaaagtacatgtgaccgaacatcagcgagtgcacacaggcgaaaaagcatacaagagacgagagtacggtaagagcttgaactcgaagtatctctttgtagagcaccagcgcacccacaatgccgagaagccttatgtttgcaacatatgcggtaagagtttcttacataagcagactctggttggtcatcaacagcggattcacacaagagagaggtcgtacgtctgcatcgaatgtggcaagtccctgtcctccaagtacagcctcgtcgaacatcaaaggacccacaacggagagaaaccatacgtgtgtaatgtgtgcggtaaatcattcaggcacaaacaaacattcgtgggacaccagcagcgtatccataccggcgagaggccctacgtgtgcatggagtgtggcaagtcgtttatccacagttatgatagaatccgacatcagagggttcacaccggtgagggcgcttaccagtgcagcgagtgcggtaagagcttcatttacaagcagagcctgcttgaccaccacagaatccatacaggcgaaagaccctatgagtgcaaggagtgcggcaaagctttcatccacaaaaaacggcttctcgagcatcagcggatacatacgggcgagaagccatacgtgtgcattatctgtgggaagagcttcatccggagctccgattacatgaggcaccagcggattcatactggtgagagagcctacgagtgctccgactgcggcaaggccttcatctcaaagcagacactcctgaagcatcacaaaatccatacccgcgaaagaccgtatgagtgttcagagtgcggaaaagggttctacctggaagtgaagctattgcagcaccagcgtattcacacccgagagcagctgtgcgagtgcaacgagtgcggaaaagtgttttcccaccagaagaggctattggagcaccagaaagtccatactggggagaagccatgtgagtgtagtgagtgtgggaagtgctttcgtcacagaacttcactcattcagcaccagaaagtccattcaggtgaacgcccatacaactgcacggcatgcgagaaggctttcatttacaaaaataagctcgtggaacaccagaggatacacaccggtgaaaaaccatatgagtgcggcaaatgcggaaaagcgttcaacaaaagatattcgctggttcgacatcaaaaggtgcatatcacggaggagccctag

SEQ ID NO: 25467 - DNA, 1923 bp, Artificial Sequence
  Description of Artificial Sequence: Synthetic coding sequence
atggctgaggctgccctggtgattacacctcaaatcccgatggtgactgaggagttcgtcaagccttcccagggacatgtaactttcgaagatattgccgtgtacttctctcaggaagaatggggcctgctcgatgaggctcagcggtgcctttaccacgacgtgatgcttgagaacttctctctcatggcttctgtgggttgtctccacgggattgaggcagaagaggctccaagtgagcagaccctttctgctcagggcgtgtcgcaggccaggacaccaaagctgggaccatcgattcccaatgctcactcgtgtgagatgtgcatcctcgtcatgaaagacatactgtacctgtctgagcaccaaggtaccctcccgtggcaaaagccctacacatcagtcgcatccggaaaatggttcagtttcggctcgaacctgcagcaacaccagaaccaagattcaggggaaaagcatattcgaaaagaggaatcaagtgccctcctgttgaactcttgtaagatcccattatcagacaacctcttcccttgtaaggatgtggagaaagacttcccgactattctaggcttgctgcagcatcagaccactcacagccgacaggagtacgcgcataggtcaagggaaaccttccagcagagaaggtataagtgcgagcaggtcttcaacgagaaggtgcacgtaacagagcaccaaagggtgcacactggtgagaaagcgtataaaagaagagagtacggtaaatccctgaattcaaaatacctcttcgtcgagcaccagagaacacacaatgctgaaaagccttatgtttgcaatatctgcggcaaaagctttctacacaagcagacattggttggccatcagcaaaggatccacacgcgggaacgctcttatgtatgcattgaatgcgggaaaagtctttcatccaagtactcactggtggagcatcaaaggacacacaatggcgaaaaaccctatgtgtgcaatgtgtgtggtaagtccttccggcataaacaaacattcgttggccaccagcagagaattcataccggcgaacgcccttacgtttgcatggagtgcgggaagagcttcatacactcttacgataggatcagacaccagcgcgtgcacacaggcgaaggtgcataccagtgttcagaatgcggaaagagttttatctacaagcaatctctgctggaccaccatcgtattcatacaggcgagagaccctatgagtgtaaggaatgtggcaaggcttttatccacaaaaaacgactgctcgagcatcagagaatacatactggagagaaaccatacgtgtgtatcatatgtggaaagtctttcattaggtcttctgattacatgagacaccagaggatccacactggggagagggcgtacgaatgtagtgactgcggtaaggcattcatcagcaaacaaaccctgctgaagcaccataagattcacaccagggagcggccttacgagtgctctgagtgtggcaagggattctacctcgaagtgaagttgctccagcaccagcggatacacacaagagaacagctgtgcgaatgtaacgagtgtggaaaggtcttcagtcatcagaagagactcctcgaacaccaaaaggtgcatacgggggaaaagccatgtgagtgttctgagtgtggtaagtgcttccgtcaccgcacaagtctaatccagcaccagaaggttcactcaggggagaggccatacaactgcaccgcctgcgagaaagcattcatttataagaataagctcgtcgaacaccaaaggatacacacaggggaaaaaccttacgaatgcggcaaatgcggaaaagcatttaacaaacgatattctctggtccggcatcaaaaggttcacatcaccgaggagccctag

SEQ ID NO: 25468 - DNA, 1173 bp, Artificial Sequence
  Description of Artificial Sequence: Synthetic coding sequence
atggccgaaaccaaagatgcggcacaaatgctggtaacctttaaggacgtggccgtaacattcacaagagaggaatggcgccaactggatctggcccaacgtaccctctatcgtgaggtgatgctggagacctgcggcctcctggtctctctgggggaccgggcacaagtccacacccgcgagccaactacctatccaccggttctgtccgagcgtgctttcttaagggggtctctgaccttagagagcagcacatcgtccgactcccgcttgggaagagccagggatgaggagggattactggagatgcaaaaaggtaaagtgacccctgagaccgacttgcataaagagactcatctaggaaaggttagccttgagggtgaaggcctggggaccgacgatggtctgcacagtcgcgcattacaggaatggctgtccgccgatgtacttcatgagtgcgattcacagcagccgggtaaggacgcattaatccacgcaggtacaaacccctacaagtgtaaacagtgcggtaaaggcttcaaccggaagtggtatttggtcaggcatcagagagtgcacactggcatgaagccatatgagtgtaatgcttgtggaaaggccttcagccagagctcaaccctcatccggcattacctgatccatacgggtgaaaagccgtacaaatgtttagagtgtggtaaggcctttaagcgaaggagctacctcatgcagcaccacccaatacatactggcgagaaaccctacgaatgtagccagtgccgcaaggcattcacccaccgcagcacattcattcgacacaaccggacacacaccggcgagaagcccttcgagtgtaaggaatgtgagaaagcattcagcaacagggcccatcttatccagcactatatcatccacacaggggaaaaaccttacgactgtatggcctgcgggaaagcttttagatgctcctcggaactgattcaacatcagcggattcacacaggcgaaaaaccatatgaatgcacacagtgtggtaaggcttttcacaggagcacttatcttatccagcattccgtcatacacacgggcgagatgccatataagtgtatcgagtgcgggaaggctttcaaaaggcgctcccacctgttgcagcaccagagagtacatacatag

SEQ ID NO: 25469 - DNA, 1269 bp, Artificial Sequence
  Description of Artificial Sequence: Synthetic coding sequence
atggctgagaccaaagacgctgcacagatgctggtcacattcaaagacgtcgccgttacattcaccagagaggagtggagacagcttgacctggcccagcgaaccctctatcgagaggtgatgcttgagacttgtggcctgctggtaagccttggacacagggtccccaaaccagagctggtccacttacttgaacacggccaggaattgtggatcgtaaaacgaggactttctcacgcgacttgtgcgggtgatagagcccaggtgcacactagagaaccgacaacctacccaccagtgttgtcagagagggcatttttgcgtggatccctcaccctcgagtctagcacctcttccgatagtagattaggcagagcaagggatgaagaggggctgctcgaaatgcagaaggggaaggtcacccccgagacagatctacataaggaaacccatctgggcaaggtttccctagagggtgagggattagggactgatgatggtctgcactcgcgcgctctgcaggagtggttgagcgccgatgtgctgcacgagtgcgattcccagcaacctggcaaagacgccttgatccacgctggcacaaatccatacaaatgtaagcaatgcggcaaagggtttaaccggaaatggtatctggtccgccaccagagggtgcacactggaatgaaaccttatgaatgcaatgcatgtggcaaggccttcagccaatcctccaccttgatcaggcattacctaatccacacaggagagaaaccttataaatgcctcgaatgcgggaaagcgtttaagcgacgttcttaccttatgcagcatcatcccatccacaccggagagaagccttacgagtgttctcagtgcagaaaagcattcacccatcgctccactttcattcgccataataggactcatactggagagaaaccctttgagtgtaaggagtgcgaaaaggccttttcaaaccgcgcacacctgatccagcattacatcattcataccggagagaaaccctacgactgcatggcctgcggcaaagcgtttagatgttcttcagaactgattcagcaccagaggattcacacaggcgagaagccttatgagtgtactcagtgtgggaaagctttccaccgaagtacttacctgatccagcactccgtaatccacaccggggagatgccttacaagtgcattgagtgcggaaaggcgttcaaacggagatcccatttgctccagcaccagagagtgcacacctag

SEQ ID NO: 25470 - DNA, 1146 bp, Artificial Sequence
  Description of Artificial Sequence: Synthetic coding sequence
atgctggtaactttcaaggacgtggcagtgaccttcactagggaggagtggagacagctggatttggcccaaaggacattgtaccgagaggtgatgctggagacctgcggactgttagtgagcctcggtgaccgggctcaggtgcatacccgtgagccaaccacttatcccccagttctgtccgagagagccttcttgcggggaagcctgacgctggagagctctaccagcagtgactccagattggggagggctcgggatgaggaagggctcctggagatgcagaagggcaaggtaacccctgagactgatctgcataaggaaactcatctgggcaaggtctcattggagggggagggtctgggtacagatgacgggctgcacagccgggcattacaggagtggctgagcgccgatgtgctccacgaatgtgattcgcagcagcctggaaaagacgcactcattcacgcaggtaccaacccttacaaatgcaagcaatgcggcaaaggctttaatcggaagtggtatttagtgagacaccagcgcgttcataccggaatgaagccctacgaatgtaacgcctgcggaaaggcgttcagccagagctcgaccttaattcggcactacctgattcacactggagaaaagccttataagtgcttggaatgtggcaaagccttcaagcggaggagctacctgatgcagcaccatccaatccatacaggcgagaagccctatgaatgctcacagtgcagaaaggcgttcacccacagaagcacatttatacgacataaccggacacacaccggcgaaaagcccttcgagtgcaaagagtgtgaaaaagcttttagcaaccgggctcatctcatacagcattacataatacacactggcgagaaaccttacgattgtatggcctgcggtaaggcattcagatgcagtagtgagctcatccagcatcagcgcatccatactggggaaaagccatatgagtgtacccaatgtggcaaggccttccacaggtcaacttacctcattcaacactctgttatccatacaggcgagatgccctacaagtgtatagagtgcggcaaggccttcaagcgcagatcccacctcctccagcatcagagggtccacacgtag

SEQ ID NO: 25471 - DNA, 1965 bp, Artificial Sequence
  Description of Artificial Sequence: Synthetic coding sequence
atggcagctgtcgctcttcgggactcagcacagggcatgacttttgaggacgtagccatatacttttcccaagaagagtgggagctattggacgagtcacagagatttttatactgtgacgtgatgttagagaattttgcacatgtgacctctctcggatactgtcacggaatggaaaatgaagcaatcgcctctgaacagagcgttagcatccaggtccgtaccagcaaaggcaacacccccactcaaaagactcatctgtccgaaatcaaaatgtgcgttccagtcctaaaagatatcttgcccgcagcagagcaccagaccacttcacctgtgcaaaagtcgtacctaggtagcactagcatgcgcggattctgttttagcgccgaccttcaccagcatcagaagcactacaatgaagaggaaccgtggaaacggaaggttgacgaggccacttttgtaactggctgtcgattccacgtgcttaactactttacctgtggagaggcgttccccgctcctaccgacctgctccagcatgaggccaccccaagcggcgaagagccccattcctcctcatctaagcacatccaggcttttttcaatgccaagagctactataagtggggcgaataccgcaaggcctcgagtcacaagcacacgttagtgcaacaccagtccgtgtgctcggaaggaggactgtacgaatgcagcaaatgcgaaaaggctttcacttgtaagaacacacttgtacagcaccagcaaatacacactggccagaaaatgtttgaatgctctgagtgcgaagaaagtttctctaaaaagtgtcaccttatactccacaaaatcatacacacaggagagcggccatacgagtgcagcgaccgggagaaagcatttatccacaagtctgagttcatccatcaccagcggaggcataccggcggagtccgacatgagtgtggcgagtgccggaaaaccttcagctataagtccaacctgatcgagcaccagagagtccacactggcgagcggccttacgagtgtggagaatgcggtaagtccttcagacaaagctcgagccttttccggcatcagcgtgtccactctggggagcgaccgtatcaatgttgcgaatgcggcaagtccttcagacagatcttcaacctgatcagacaccgcagagtgcataccggcgaaatgccgtatcagtgttccgactgtggcaaatccttcagctgtaaatctgagcttatacaacaccaacgcatacattcaggtgaacggccttatgagtgtagagaatgcggaaaaagtttcaggcagttcagcaacctgattcggcatcggtctattcacaccggagatcgcccttatgaatgctccgaatgtgagaaaagcttctctaggaagttcatattgattcaacaccagagagtacacactggggaacgcccttacgagtgtagcgaatgcggtaagagcttcacgcggaaatccgacctgatccagcaccggcgaatacatactgggactagaccgtacgaatgctcagaatgtggcaagtctttccggcagcgcagtggcctgatacaacacagaagactccatacaggtgagaggccgtacgagtgttcggagtgtggtaagagtttctctcagagcgcttccctgatccagcaccagcgggtgcatacaggggaacggccatacgaatgttcagagtgcggcaagtcattctctcagtcttctagtctgatacagcatcagagaggccacactggagagcgaccctatgaatgctcccagtgcggcaagccatttacgcacaagagcgatctaatccaacaccagcgggtgcacacgggtgaacggccatatgaatgtagcgagtgtggcaaatccttctctcgaaaatctaatctgattcggcacaggcgcgttcatacagaagaacgaccatag

SEQ ID NO: 25472 - DNA, 2013 bp, Artificial Sequence
  Description of Artificial Sequence: Synthetic coding sequence
atgcccgcacctgtcggaaggcgcagtccacccagcccacgctctagcatggcagccgtggctttacgagattcggcccagggaatgacgtttgaagatgttgcgatatactttagccaagaggagtgggaactgttggatgaaagccaaaggtttctctactgtgatgtcatgctcgagaacttcgcccacgtgaccagcctgggttactgccacggaatggagaacgaggcgatcgcaagtgaacagagtgtctctatccaggtcagaactagcaaagggaatactccgacccaaaaaacccatctgtccgaaataaagatgtgtgtgcctgtcctaaaagacatactgcctgcagctgaacatcaaaccacttcacctgtacaaaagtcatacctggggtccacatcgatgagaggtttctgcttttcggcagatctccaccaacatcaaaagcactacaatgaagaggagccttggaaaagaaaggtcgacgaagccacattcgtgactggatgtagattccatgtgctcaattatttcacttgtggagaagcgttcccggcaccgactgatctgttacaacatgaagctacgccctcaggcgaagagccccattccagctcctctaagcacatccaggcttttttcaacgcaaaaagctactacaaatggggcgagtacaggaaggcctcttcccataagcacactctggtgcagcaccagtcagtgtgttctgaggggggtttatacgaatgtagtaaatgcgagaaagcatttacttgcaaaaatacactggttcagcaccaacaaattcacaccggccagaaaatgtttgagtgctctgagtgtgaagaatcttttagtaaaaaatgccatttgatccttcacaaaatcatccacaccggggagagaccttacgagtgctccgacagagagaaggcgtttattcataaatccgaattcattcaccaccagcggcgtcacacgggtggcgttcgtcatgaatgtggcgagtgtaggaaaaccttctcctataagtctaatttgattgaacaccaaagggtacacaccggtgagaggccctatgagtgcggggagtgtggcaagtcattccggcagtcaagctctctcttcaggcaccagagggtgcattccggcgaacgaccctatcaatgctgcgaatgtggcaagagcttccgtcagatcttcaatttaatcaggcacagacgggtccacactggggagatgccataccaatgctctgactgcggaaagagtttttcttgcaagtctgagctcattcagcatcagcgcatccatagtggggaaaggccatacgaatgtcgggaatgtggcaagagtttcaggcagttttccaatcttattagacacagaagcatccatacaggcgacagaccgtatgagtgttccgagtgcgaaaagagtttctcacgtaagtttattttgatacaacatcagcgggttcacaccggggagcgaccctatgagtgctccgagtgtggcaaatcatttactcggaagtcagatttaattcaacaccgcaggatccataccgggacacggccttacgaatgttccgaatgtggcaagtccttcagacagaggagcggtctgatccaacaccgccgacttcacacgggcgagcgaccctacgaatgtagcgaatgcggcaagtcgttctcacaaagtgcttctctcatacagcatcaaagggtccatactggcgagcgcccttatgagtgttcagagtgtggaaagtcattttctcagtcgtcttctttaattcagcaccagcggggtcataccggtgaaagaccttatgagtgctcacagtgcgggaagcctttcactcacaaatccgacctgatccagcatcagagagtgcatacaggggagcgcccttatgaatgttcagagtgcggcaagtcttttagtcgtaagtccaatttaatcagacaccgcagggtacacacagaggaacggccttag

SEQ ID NO: 25473 - DNA, 1269 bp, Artificial Sequence
  Description of Artificial Sequence: Synthetic coding sequence
atgaccttcgaagacgtggcaatttactttagccaggaggaatgggaacttcttgatgagagccagcgcttcttatactgcgacgtgatgttggagaatttcgcacacgtgacctctctggtgactagccatcagaaacactataacgaggaagagccttggaagagaaaggtcgacgaggcaacttttgttaccggatgtcgtttccacgtgttgaactatttcacctgtggtgaagcttttccagcaccgaccgacctgttgcagcacgaagccactccgagcggcgaggagccccattcatcaagctctaaacacatccaggcattcttcaacgctaaatcttattacaagtggggcgagtacagaaaggcgagctcccacaagcacaccctggtccagcatcagtcccgcgttcatactggcgaacgcccttatgaatgtggggaatgcggaaaaagcttcaggcagtcgtcctccttattcaggcaccagagggttcacagcggcgaacgaccttatcagtgctgtgagtgcggaaaatccttccgtcagatctttaacctaatacgccacaggcgggtacacaccggcgaaatgccataccagtgttcggactgcggcaagtcgtttagctgcaagagcgagctcatccagcaccaacgtatccatagtggggaaaggccctacgaatgtcgtgagtgtggcaagtctttccgacagtttagcaacttgatcaggcaccggtctatccacacaggagataggccctacgagtgctccgaatgtgaaaagtcttttagtagaaaattcattctcattcaacaccaacgggtgcatacaggcgagagaccttacgaatgttctgagtgtggcaagagctttactcgtaagtccgatttgatccaacacagaaggatccacacaggcacgcgcccatacgaatgcagcgaatgtggaaagtctttcaggcaacgctcaggtttgatacagcaccggaggctgcacacgggcgagaggccatacgaatgttctgagtgtgggaagagtttttcccagagcgctagcctgatccagcatcagcgggtgcatactggagaaaggccctatgaatgtagcgagtgcggcaagagcttcagccagtcatctagtctcatccagcaccagcggggacacacaggtgaacgaccttacgaatgttcacaatgtgggaagcccttcactcacaagtctgatctgatacagcatcaaagggtgcatacaggatag

SEQ ID NO: 25474 - DNA, 1224 bp, Artificial Sequence
  Description of Artificial Sequence: Synthetic coding sequence
atggctgcggcagcgctgcgtttccccgtgcagggtactgtgacgtttgaagacgtggccgttaagttcacgcaggaagagtggaatcttctttctgaggcccagagatgcctgtaccgcgatgtgactttggagaatctagcactcatgtcctccttgggctgctggtgcggagtggaagacgaagccgctccctcaaaacaatccatttatatccagcgggagacgcaggttcgcacacccatggccggagtttccccgaaaaaagcccatccttgcgagatgtgcggccctatcctgggggacatcctgcatgtcgctgaccaccagggcacacatcacaaacagaagctgcacagatgcgaagcatggggcaacaagctttatgattctggtaatttccatcaacatcagaacgagcatataggcgagaagccttacagaggcagtgtggaagaggcgttattcgcgaagaggtgtaaactgcacgtcagcggcgaatcatcagtcttcagtgagtctggaaaagacttcctactgaggtctgggctgcttcagcaggaggccacgcataccggaaagtccaattctaaaaccgagtgcgtgtccctatttcacggaggaaagagtcactattcttgtggcggatgtatgaaacacttttcaactaaggatatcctttctcagcacgaacgtttgttgccaacagaggaaccgtctgtgtggtgtgaatgcggtaagagcagtagtaaatacgattccttcagtaatcatcagggtgtacatactcgtgagaagccatacacatgtggaatttgcggtaagctgttcaattctaaaagccaccttctggtgcaccaaagaatacacaccggagaaaaaccgtacgagtgcgaagtatgccaaaaattctttcggcataagtatcatctgatcgcccaccagagagttcataccggcgaaaggccttatgagtgcagtgactgtggcaaatcatttactcactccagcaccttcagagtgcacaagagggtgcatacagggcagaagccctacgaatgctccgaatgcggaaaaagtttcgccgaaagctccagtctcactaaacatcggcgtgtgcacactggggagaagccctatggttgttcggaatgtgagaaaaagttcagacagataagctccttacgccaccaccagagagtgcataaaaggaaaggcttatag

SEQ ID NO: 25475 - DNA, 1617 bp, Artificial Sequence
  Description of Artificial Sequence: Synthetic coding sequence
atggtgacctgtgcacacctaggacgtcgcgctcggctcccagcggctcagcctagcgcctgccccggaacttgttttagtcaggaggaaagaatggctgcaggatacctcccgcgatggagccaagagcttgttacatttgaagatgtgtctatggacttttcacaggaggagtgggaattgctggagcccgctcagaagaatctttaccgggaggtgatgctggagaactaccggaacgtggtgagcctggaagcactcaaaaaccaatgcacagatgtgggcatcaaggagggccctttgagcccagcgcagacttcgcaggtgacttctctgtcctcatggacagggtatctgctattccaacccgttgcatcttctcacctcgagcaacgcgaggcactatggatcgaggaaaaagggactccacaggccagctgtagcgactggatgactgttttaaggaaccaggactccacttataagaaagtggccctccaggaagaacctgcaagtgggatcaacatgattaaactgattcgggaagacggtggctggaagcagctcgaagactcgcacgaggatccacagggccttctttcgcagaaggctagcttacacgtggttgctgtgccacaggaaaaagcaactgcttggcacggattcggcgaaaacggaaacctcagccctgccctggtgctctcacagggctccagcaagggcaatcatctttgtggctcggagctcgacatcacctccctggcctccgattctgttcttaaccaccatcagctcgggtacgccgatcgtaggccatgtgaatccaatgagtgtggtaacgccattagacaaaatagccactttatccaacacgggggaaaaatgtttgtctacttggaaaatgggcagtccctgaatcatggcatggcgctgaccatccacaacaaaatcaatactgcagagaagccatttgaatgtcaccagtgcgggaaagtgttcaatagacgtcactctttaagcgagcatcagaggattcatactggggagaagccttacgagtgtcaggagtgcggccgtgcttttacacactctagcacccttaccaggcatctcaggactcacaccggcgaaaagccttacggatgtggtgagtgcgggaaggccttcaacagaatttcttccctcactcagcatcagcgcatccatacaggggaaaaaccatacaaatgcgaggattgcggtaaaagtttctgccaaagttcctacctgatactccacaagcgcacacacacaggagagaagccatacgaatgctcagagtgcgggaaggcattcagtgacaggtctagcttgaatcaacatgagagaacccatacaggcgagaacccttatgagtgtaaacagtgcgggagggcattctcacagcgttcttcgttggtgcgtcacgaaagaacccacactggggagaaaccgtacaggtgtcaagagtgtgggaaggccttcagccagagttcctcactggtgacccaccagaagacacatagttctcagaagacctacaaaattattgactgcgggaaggccttctatcaaaacagacatctcatagggtactag

SEQ ID NO: 25476 - DNA, 1887 bp, Artificial Sequence
  Description of Artificial Sequence: Synthetic coding sequence
atggactccgtcgtctttgaggacgtggccgttgattttactcttgaggagtgggccctgctggattctgcccagcgagacctgtaccgcgacgtgatgctggaaacattccaaaacttggccagcgtcgacgatgagacccagtttaaagctagcgggtcggtcagtcaacaagacatctatggcgaaaagatccctaaggaatcaaagatcgccacctttacaagaaacgtgtcctgggccagcgtgctgggaaaaatctgggactcactcagtattgaggaccaaaccactaaccaggggcgtaacctttccaggaatcacgggctagagcgcctctgtgagtctaatgatcaatgcggcgaggctctttcacagatacctcatctcaacctgtacaagaaaatcccacccggtgtcaaacagtacgagtataatacttatggtaaggtgtttatgcaccggaggacgtccctcaagtccccaatcaccgtgcatacaggtcacaagccataccagtgtcaggagtgcggtcaggcatactcttgtcgcagtcacctgcgaatgcatgtacgcacccacaatggcgagcgtccttacgtatgtaagctatgcgggaagacttttccgcgaacctcctccttgaataggcacgtccgcatccatacagctgagaaaacttacgaatgtaaacagtgtggaaaggcttttatcgacttcagtagtctgacttcccatctacgaagtcatactggcgaaaagccctataagtgcaaggaatgtggcaaagccttcagctattcctctaccttccgcagacacaccatcacacatacgggagaaaaaccgtataagtgtaaggagtgtgccgaggcattctcttactcgtcaacattccgaagacacatgatctcgcataccggagagaaacctcacaagtgtaaggaatgtggtgaggccttctcttatagctctgcgttccgcagacacatgatcactcataccggggaaaagccatacgaatgcaagcagtgcggcaagacatttatataccttcagagtttccgaagacatgagcggatccacaccggcgaaaagccttatgagtgtaagcaatgtggaaagacctttatataccctcaaagcttcaggaggcacgagaggactcacggtggcgaaaaaccatacgaatgtaatcagtgcggtaaggccttttcccaccccagctcatttagaggacacatgagagtccacactggcgagaaaccttatgagtgcaagcaatgcggcaagactttcaattggcccattagtctaagaaaacatatgcgtactcatactagggaaaagccctacgaatgtaaacaatgcggcaaggccttcagtctgagtgcctgttttcgcgagcatgtgcgcatgcatcccgaggacaaaagttacgagtgtaagctgtgtggtaaagccttttattgccacattagcttgcagaagcacatgagacgccacaccgccgaaaaactgtacaagtgcaaacagtgcgggaaagcattttcttggcccgagctgctgcaacagcatgtgagaacccacaccgtggagaaaccctatgaatgcaaagaatgcggcaaggtcttcaagtggccgtcgtctctgcccatccacatgcggctgcatactggagagaagccttaccagtgcaagcactgcggaaaagccttcaactgttcttcttcactgcggagacacgtgcgcatccatactacagaaaaacagtacaagtgtaacgtgggccatcccccagctaacgagttcatgtgcagtgcatcggaaaagtctcaccaagagcgagacctaataaaggtcgtgaacatggtcctgcctctctag

SEQ ID NO: 25477 - DNA, 1632 bp, Artificial Sequence
  Description of Artificial Sequence: Synthetic coding sequence
atggacagtgtggtctttgaggatgtcgcagtcgattttactctggaagagtgggcccttctggactccgcgcagcgggatctgtatcgagacgtgatgttagagacatttcagaacctggccagcgtggatgatgagacccagttcaaggcctctgggtccgtgagccagcaggatatctatggcgaaaagattcccaaggagagtaaaatcgccaccttcactcgcaatgtgtcgtgggcctcagttctgggaaagatttgggactctcttagcattgaggatcagaccactaatcagggaagaaatttgcggaatcacggcctggagcgcctttgtgaaagcaacgaccagtgcggggaggccctctcccaaattcctcaccttaatctgtacaagaaaattcccccaggcgttaaacagtatgaatataatacctacggcaaagtcttcatgcacaggaggactagccttaaatcccccatcaccgtgcatactggacataaaccctaccaatgccaagagtgcggccaggcatatagctgccgctctcacctgagaatgcatgtcagaacacacaacggcgaacggccatatgtctgcaaactctgcggcaaaacctttccaagaaccagctcgctcaatagacatgtcagaattcatactgctgaaaaaacttacgagtgtaaacagtgtggtaaggctttcatcgacttctcctcattgacttctcatctgcgtagccatacgggagagaagccttacaaatgcaaagagtgtggtaaggccttctcttacagcagtacgtttcgacgccataccataacccacaccggcgagaagccctacaaatgcaaagagtgcgcggaggctttttcttactcaagtaccttcaggcgtcacatgatatctcataccggcgagaaacctcacaagtgtaaagagtgtggggaggcattttcgtatagttcggccttccgaaggcacatgattactcacactggcgagaagccttatgagtgtaaacagtgtggaaagacattcatttacttgcagtctttcaggagacacgagcgtatacatactggagaaaaaccctacgaatgtaagcagtgtggtaagacatttatctatcctcagtcctttcgtagacacgagcggactcacgggggagaaaaaccatacgagtgtaaccagtgtggcaaagccttcagtcacccctccagcttccggggacacatgcgggtgcacacaggcgaaaagccctatgagtgcaaacagtgtggcaaaacatttaactggccaatctccctgagaaagcacatgaggacacacacgcgcgagaaaccttacgaatgcaaggagtgtggcaaggtgttcaagtggcctagcagcctcccgatccatatgcgccttcacacaggtgaaaagccatatcagtgcaagcattgtggaaaggcgtttaattgcagctcttccttaagaaggcacgtcaggatccataccacagaaaaacagtacaagtgtaatgtcggccatcctcctgccaacgagtttatgtgtagcgcttccgagaagtcacatcaagagagagatctcatcaaggtggtaaacatggtgctgccactgtag

SEQ ID NO: 25478 - DNA, 1371 bp, Artificial Sequence
  Description of Artificial Sequence: Synthetic coding sequence
atggataccgtcgtgtttgaggatgtggtagtggactttactctcgaagagtgggccctgttaaacccggcacagagaaagctctatcgggacgtaatgctggagaccttcaagcacttagccagcgtcgacaacgaggcgcagttaaaagcctcgggctccatctctcaacaggatacctctggtgagaagctctctcttaaacagaagattgagaagtttacccgcaagaacatctgggcttctctgctgggaaagaattgggaagagcactctgtcaaggataaacacaatacgaaggaacgccacctgtctcggaatcccagagtggagaggccatgcaaaagtagcaagggcaataaacgcggtaggactttcaggaagacccgaaactgtaaccgtcacctgcgtaagaactgttgtacttctgtccggcgttacgaatgctcgcaatgtggaaagttattcacccatagctcttctctgatacgacacaagagagctcactcaggtcagaagctttacaaatgtaaagagtgtgggaaggccttctccaggccctcctacctgcagacacatgaaaagacgcattcaggcgagaagccttacgcgtgccagtcctgtgggaaaaccttcttgcgcagtcatagtctgacagaacacgtccggacacataccggtgaaaagccctacgaatgtggccaatgcggaaagggcttttcttgtcccaaatcattcagagcccatgtgatgatgcacgccggtggtagaccatatgaatgcaagcactgcggtaaggcctttaggtgccagaaatctttcagagtgcatatgattatgcacgccggagggagaccctacgagtgcaaacaatgtggcaaggcctattgctgggccacctcgtttcagaggcatgtcaggattcacaatggggagaaaccatacaagtgtggaaagtgcggaaaggctttcggatggcctagcagcttacacaagcacgctagaacacacgctaagaaaaagccggtaagcggaggaagcgtgggcaagagcagcgcaagaccacgaccctccaccgatgtgaagtcccagacacgagagaaagtgtacaagtgtgaaacctgcggcaagacctacggatggtcttctagcctccataagcacgagagaaagcataccggtgaaaagccagtcaatgcggcaagtgtgggcaagccgtccgggggactgtgctcaagtaagaatgtgcgtacccagatcgggcaaaagccttccaagtgcgaaaagtgcggaaaagccttttcatgtcctaaagccttccaaggccatgttaggagccataccggcaaaaagagttgtaccagcaagtag

SEQ ID NO: 25479 - DNA, 1293 bp, Artificial Sequence
  Description of Artificial Sequence: Synthetic coding sequence
atggccgcagtggtgttgccaccaacagcagcattgtcctccttatttcccgcatctcagagggagggccacaccgaggggggagaactcgtcaatgagctactgaagtcttggctgaagggtttagttacatttgaagatgttgcagtggagtttacacaggaagaatgggccctcctggacccagcccagaggacattataccgcgatgtgatgcttgaaaactgccggaatctggctagccttggcaatcaggtggacaaacccagactgatctcgcagctggagcaggaggacaaggttatgactgaggaaagggggatcttaagcggcacatgtccagacgtagagaatcccttcaaagcaaaggggctcacacccaagctgcacgttttcaggaaggaacagtcccgcaatatgaaaatggaaagaaatcacctgggggcaactctgaatgaatgcaaccaatgcttcaaagtgttttctacgaagtcttccttgactcgacatcggaaaattcacacaggcgaacgcccttacggatgctccgagtgcggtaagtcctacagcagcaggtcttatctggctgtgcacaaaaggatccataatggtgagaagccctacgaatgcaatgactgcggaaaaacattttccagccgctcctatctgaccgtgcacaagagaattcacaacggcgaaaaaccatacgaatgttcagactgcggtaaaaccttttcaaatagttcttacctcagaccacacctacggattcacactggggagaaaccttataagtgcaatcagtgttttagagagttccgcacccagtccatattcactagacacaaacgcgtacatactggcgagggccactatgtgtgcaatcaatgtggaaaggccttcggtaccaggtcctcactgtcaagccattactcaatccataccggcgaatatccatatgaatgccatgattgcgggaggacctttcgcaggaggagtaacctcacacagcatatccgcacccacacgggggagaaaccttacacatgcaacgaatgcgggaagtcttttacaaactccttcagcctcactatccacaggcggattcacaacggggaaaagagctatgaatgctcggactgtgggaagagctttaacgtgctcagcagcgtgaaaaagcacatgcgcacacacaccggaaaaaaaccctacgagtgtaactactgcggcaagtcatttacctcaaactcttacctctccgtccatactcgtatgcacaatcgccagatgtag

SEQ ID NO: 25480 - DNA, 1293 bp, Artificial Sequence
  Description of Artificial Sequence: Synthetic coding sequence
atggctgcagttgtcctccccccaactgccgcactgagtagtctgttccccgcatcacagagggaggggcacaccgaaggaggtgagttagtcaatgagctgctgaagtcttggctgaaggggttggtgacatttgaagatgttgcagtcgagtttacacaggaggaatgggccctgctagaccccgctcagaggacattgtatagagacgtgatgctcgaaaactgccgcaatctggcctcactgggcaaccaagtcgataaacccaggctgatatcacaactcgagcaggaggacaaagttatgacagaggagcgtggcattctgtccggaacctgtcctgatgtcgagaatcctttcaaggcaaaggggctgacgcccaaacttcatgttttcaggaaagaacagagccgaaacatgaagatggagaggaatcatctcggcgctactctgaacgaatgcaatcagtgttttaaggtgtttagcactaaatcttcactcactcgccatcggaagatacatactggagaaaggccctatgggtgctctgagtgtgggaagagttactcatctaggagctacctcgccgttcacaaacggatccataacggggaaaaaccctacgaatgtaacgattgtggcaagacatttagcagcaggagctacttaactgtgcacaagcggattcataatggggagaagccttacgagtgctctgattgtggcaaaacattctcaaattcatcttacttgaggccccacctgcggattcataccggtgaaaaaccttataagtgtaatcaatgttttagggagttccgaacccagtccatattcacccgccacaagcgcgttcacaccggcgaaggtcattatgtttgcaaccaatgcggtaaagcctttggtacccgcagtagtctcagctcacattactctattcacaccggagaatacccgtatgagtgccacgattgcggcaggacattccgccgacggagcaaccttactcagcatatacggactcacacaggggaaaagccctatacttgcaacgaatgcggtaaaagctttacaaacagtttttccctgacgattcaccgcaggattcataatggcgagaaaagctacgagtgctcagattgcggaaaatctttcaacgtgctgtcctccgttaagaagcacatgaggactcatacgggtaagaaaccatacgagtgtaactactgcgggaaaagcttcaccagcaacagttaccttagtgtacatacacgcatgcataaccgccaaatgtag

SEQ ID NO: 25481 - DNA, 1272 bp, Artificial Sequence
  Description of Artificial Sequence: Synthetic coding sequence
atggctgccgtggtattgcccccaacagcagcttcccaacgggagggccacacagagggcggtgaactcgtgaatgagctcctcaagagttggttgaaaggcttggtgacatttgaagacgtggccgttgaatttacacaagaggaatgggctctcctggatccagcccagagaacgctgtacagagacgtgatgctggaaaactgccggaatttggcctctctggggaatcaagtggataagccaaggctaatctctcagttggagcaagaagacaaggtgatgaccgaagaacgagggatcctttcagggacatgtcctgacgtcgagaacccctttaaggcgaaggggctgacgccgaaacttcacgtgtttaggaaagagcagagtcgtaacatgaagatggaacgtaaccatctgggtgccaccctcaacgagtgcaatcagtgtttcaaggttttcagcactaagtccagcctgacccggcaccgcaaaatccacactggagagcgtccctacggctgttcagagtgcggcaaatcatactcatctaggagctatctagcagtgcacaagcggatccacaatggcgagaagccttatgagtgtaacgactgcggaaagaccttcagttcgagaagttatctcacagtgcataagcgcattcacaacggggaaaagccatacgaatgctccgattgcggaaaaacattttctaacagctcatacctcaggccccaccttcggatccataccggcgaaaaaccgtataagtgcaatcagtgttttagagagttcagaacccagtccatctttacacggcacaagagggtccacaccggagagggacactatgtgtgcaatcagtgcgggaaagcttttggaacacgtagcagcctgtcctcacactattctattcataccggtgagtacccttatgaatgtcacgactgtggtagaacattccgccgaaggtctaatctgacccagcacattaggactcacacaggcgagaagccttatacgtgcaacgaatgcggcaagtctttcacaaactctttctcccttaccatccatagacgcatccataatggggaaaagtcatatgagtgctccgactgtggcaaaagcttcaatgtcctgagcagcgttaagaagcacatgcgcacccatacaggtaaaaagccatacgaatgcaactattgtggtaagagttttacctccaattcttacctttccgtacatactcggatgcacaacagacagatgtag

SEQ ID NO: 25482 - DNA, 1209 bp, Artificial Sequence
  Description of Artificial Sequence: Synthetic coding sequence
atggcagctgttatcctaccatccactgctgccccttcaagtctgttccctgcctcccaacagaaaggtcacacacagggtggggagttggtcaacgagctcctcacttcttggttacggggtctagtgaccttcgaagatgttgccgttgagtttacccaggaggagtgggctctgctcgatccagcccagagaaccttgtatcgcgacgtcatgctggagaactgtcggaatctggcctctctcgggtgtcgggtgaataaaccctctctgatcagccaacttgagcaggataaaaaagttgtaaccgaagagcgtggcatactgcctagcacatgtcctgacctggaaacacttctcaaggctaaatggcttacccccaaaaaaaatgtgttcaggaaggagcaaagcaaaggagtaaaaactgaacgcagccaccgcggagtcaagttaaatgagtgtaatcagtgcttcaaagtcttttccaccaaatccaacctcacacagcataagagaatccacaccggtgaaaaaccatacgactgttcccaatgcgggaagtcatttagttcccgaagctacctaactatacataagcgaatccacaatggggaaaagccatacgagtgcaatcactgcggaaaagccttctccgatcccagctctctgcggctgcacctgcggatccacaccggcgaaaaaccgtatgagtgcaaccagtgttttcatgtgttcagaacctcatgtaatcttaaatcccataaacggattcacactggtgaaaatcaccacgagtgtaatcagtgtggaaaggcctttagtactagatcttccctgaccggtcacaactccatccataccggagaaaagccttatgagtgtcacgattgtggaaagacgttccgcaaatcttcttatctgacacagcacgtgcggacccacacgggagaaaagccttacgagtgcaatgaatgcggtaaaagtttctccagttctttttccttgactgtacataaaagaattcacactggagaaaagccatacgaatgttcggactgtggaaaggctttcaacaatctatcggcggtgaagaagcacctccgcacacatacgggggaaaaaccttacgagtgcaatcactgcggtaagtcattcacatctaacagctacctcagtgtgcacaaacgcatacataacaggtggatttag

SEQ ID NO: 25483 - DNA, 996 bp, Artificial Sequence
  Description of Artificial Sequence: Synthetic coding sequence
atgctcgagaactgccgtaacttggcttcactcggatgccgtgtgaacaagccctcgctcatcagccagctggaacaggacaaaaaagtggtgaccgaggaacggggaatcctgccatcaacgtgcccagacctcgaaacgcttctgaaagccaaatggttaactcccaagaaaaatgtgttccggaaagagcagtccaaaggagtgaagaccgagcgcagccatcggggagtgaaattgaacgagtgcaaccagtgctttaaagttttctctaccaaaagtaatttgacccaacataaacggattcatacgggcgaaaagccatatgattgctctcagtgtggaaaaagcttttccagtcggtcatacctgacaattcacaagcggatacacaacggtgaaaaaccatatgaatgcaaccactgtgggaaggcgttctccgatccctcaagtctgaggctgcacctgaggatccacaccggagaaaaaccctatgagtgcaatcaatgcttccacgtctttcgaacgagttgtaacctgaagtctcacaaacgaattcataccggagagaatcaccatgaatgtaatcagtgcggaaaagcctttagcaccagaagctccctcacggggcacaattcaatccatacaggcgagaagccatacgaatgccacgattgtgggaaaacctttcggaaatctagttacctaacacagcacgtgagaacgcacaccggcgaaaagccgtatgaatgtaacgagtgcgggaagtcctttagcagctctttctccttgactgtacacaaacgcatccacaccggtgagaagccctacgaatgcagcgactgtgggaaggcatttaacaatctctccgccgtgaaaaagcatctgagaacccataccggcgagaagccctacgaatgtaaccactgtggcaaaagtttcacttccaacagctacctgtccgtccataaacgcatccacaatcggtggatctag

SEQ ID NO: 25484 - DNA, 1617 bp, Artificial Sequence
  Description of Artificial Sequence: Synthetic coding sequence
atggtggcaggttggctcaccaactactcacaggacagtgtcactttcgaagatgtggccgtggattttactcaggaggagtggactctgctggatcagacacagcgcaacctgtaccgggatgtgatgctggagaattataaaaatctggtcgccgtcgactgggagtcgcatatcaacacaaagtggtcggctccgcagcagaactttcttcagggtaagactagctctgtagtcgagatggaaaggaaccactttggcgaggaacttttcgacttcaaccagtgtgaaaaggcactttctgagcactcgtgcttaaaaactcataggaggacctatttcaggaaaaagacctgtgagtgtaatcagtgtgagaaggcatttcgcaaaccctctatctttacgctccacaaaaaaaccgatataggggaagagctcccaaactgcaaccaatgcgagaccgcatttagccaacacttacacctcgtatgcaaaaagacttctcagaacctccacctagtttgtaaaaaaactcacactcaggaaaagccctacaagtgcagtgactgtgagaagggcttaccttcatccagccaccttcgcgagtgcgtaagaatatacggtggggaacgaccctatacccataaagaatacgtagagaccttctcccactcgactgccctgtttgttcatatgcagacccaggatggggagaaattttacgaatgcaaagcgtgtgggaagccttttactgagagcagttatttaacacaacacttgagaactcactctagagtcttgcctatcgagcataagaaattcggcaaggccttcgcgttttctcctgacctggctaaacacatccgattgagaaccagggggaaacattatgtgtgtaatgaatgtgggaaggagttcacctgctttagtaagcttaacatacacattagagtccacaccggggagaagccttacgaatgtaataagtgtggaaaagcattcacagactcctctgggctgattaagcaccgtaggacgcacactggagaaaaaccgtacgaatgcaaagagtgcggtaaggcattcgcgaactcctctcacttaacggtgcatatgagaactcacaccggggaaaagccttatcaatgcaaggaatgcggaaaagccttcattaactccagttctttcaagtcccatatgcagacgcatcctggtgtgaagccatacgactgccagcagtgtggaaaagcctttatacgctcctcattcctgatcagacacctaaggagtcactcggccgagagaccgttcgagtgcgaagagtgcggaaaggcctttcggtactcctcgcaccttagccagcataagcggatacatacaggggaaaggccctacaagtgccagaagtgcgggcaggcgtttagtatcagcagcggtctgaccgtccacatgcgcacccataccggagagaggcctttcgaatgccaggaatgcgggaaggctttcacaaggagtacctacctgatcaggcacctcagatcacacagcgttgagaagccctataaagaatgtgggcaaacattctccaactctagctgcctgacagagtgcgtctag

SEQ ID NO: 25485 - DNA, 1617 bp, Artificial Sequence
  Description of Artificial Sequence: Synthetic coding sequence
atggtggctgggtggctgacaaattattcccaggatagcgttacgttcgaggacgttgccgtggacttcacccaggaagagtggacgctgctcgatcagactcagcgaaacctgtacagggatgtgatgcttgaaaactacaagaatcttgtggctgttgattgggaatcacatatcaacaccaagtggtccgcaccacagcagaatttccttcagggaaagacatccagcgtggtagagatggagcgaaaccacttcggggaggaattgtttgattttaatcagtgcgagaaggcactgtccgaacatagttgcttgaagacccatagacgaacctactttaggaagaagacatgtgagtgtaatcagtgcgagaaagccttccggaaaccctctatctttactctccacaagaaaaccgatatcggtgaggaactgccaaactgtaaccagtgtgaaactgctttctcacaacatctgcatctggtgtgtaagaagactagccagaacttgcacctcgtctgcaaaaaaacacacacccaggagaagccatataagtgctcagactgcgagaagggactaccctcatcttcgcatttgcgagaatgtgtcagaatctatggcggtgagcgtccttacacccacaaagaatatgtagaaaccttcagtcactctaccgcactcttcgtgcacatgcagacacaggacggagagaagttctacgagtgcaaggcctgcgggaagccgttcactgaaagttcatacctcacccagcacctgcgaacgcactcccgagtgcttcctattgagcacaagaagttcggtaaggccttcgctttcagtcctgacctcgccaaacatatcagacttcgaacccgcggtaagcactatgtgtgcaacgagtgtggcaaagaatttacctgtttcagcaaactgaacattcacattagagtgcacactggcgaaaaaccttacgaatgcaacaagtgtggcaaagcattcactgattccagcggactcattaagcatcgaagaacccatactggagaaaagccatatgagtgcaaggaatgcgggaaggcatttgccaacagctcccatttaacagtgcatatgagaacacatacgggcgaaaagccttaccagtgtaaagaatgtggaaaagctttcatcaactcatcatcgtttaaatctcacatgcaaacacaccccggtgtaaagccatatgattgtcagcaatgcgggaaagccttcattcggagctccttcctcatcaggcacctgcgcagccactcggcagagaggccctttgaatgcgaggagtgtggcaaggccttccgctactcgagtcacctcagccagcataagaggatacacaccggtgagcgaccttacaaatgccagaagtgcggtcaggccttctctatatcctccgggctgaccgtgcacatgcgcactcatacaggagaaagaccattcgagtgccaggagtgcggcaaagcatttactagatcaacttatctaattcgacatctgaggtctcatagcgtagaaaagccttataaggaatgtggccagacctttagtaatagctcatgcctgaccgagtgtgtgtag

SEQ ID NO: 25486 - DNA, 1377 bp, Artificial Sequence
  Description of Artificial Sequence: Synthetic coding sequence
atggaacggaaccacttcggtgaggagttattcgatttcaatcagtgtgaaaaagcactcagcgagcacagctgtttaaaaactcataggcggacctattttagaaagaaaacctgcgagtgtaaccagtgtgagaaggcttttcgcaagccctccatcttcaccctacacaagaaaaccgacataggtgaggaactgcctaactgtaaccagtgtgaaacggccttcagccagcatttgcacctcgtgtgcaaaaaaacgtcgcagaatctacacctggtgtgtaagaagacgcacactcaggaaaagccctacaagtgttccgattgtgagaagggcctgccatcaagctcccaccttcgcgagtgcgttagaatttatggcggtgagcgcccatacacgcacaaggagtacgtggagaccttctcacacagcaccgccctctttgttcacatgcagacgcaggatggagagaagttttatgagtgtaaagcctgtggaaagcccttcaccgagagcagctatctgacacagcacctacgaacacactcaagggtgctgccaatcgaacataaaaaatttggcaaggccttcgcattttcgccagatttggcgaaacacataagactgcgcacaaggggaaaacattacgtgtgcaatgaatgcggcaaagaattcacatgtttctcgaaactgaatatccacattagggtgcacacaggcgaaaagccgtacgagtgtaacaaatgcggcaaggccttcacagattctagtggcctgatcaaacacaggcggacacacaccggcgagaaaccatatgagtgcaaggagtgcggcaaagccttcgccaatagctctcacctgacagttcacatgaggactcacacaggagaaaagccatatcaatgtaaggaatgcgggaaggctttcataaattcctcatccttcaaatcacacatgcagacccaccccggagttaagccttatgattgccagcagtgtggcaaggcatttattcgttcaagctttctaattcgtcatctgcggtcgcattcagcagaaaggccttttgaatgtgaagagtgtggcaaggcctttcgatactcatctcatctcagccaacacaaacgaatccacaccggtgaacgaccatacaaatgccagaagtgtggacaggccttcagcatcagcagtgggctgaccgttcatatgcggactcacacgggcgagcgcccattcgagtgccaggaatgtggtaaggccttcacacgttctacctaccttatcagacatctcaggagtcattcggttgaaaaaccctacaaggagtgcggccagacattttccaacagctcgtgtcttacggaatgcgtctag

SEQ ID NO: 25487 - DNA, 1617 bp, Artificial Sequence
  Description of Artificial Sequence: Synthetic coding sequence
atggtggcagggtggctcactaactatagtcaagattccgttacattcgaggacgtcgcagttgactttacccaggaggaatggacattgctggaccagacccagagaaatctgtatcgggacgtgatgttagaaaattacaaaaatctggttgccgttgattgggagagccatatcaatacaaagtggtctgccccacagcaaaacttccttcaaggcaaaacatcaagcgttgtggaaatggagcgcaatcactttggcgaggagctattcgatttcaatcagtgtgagaaagccttgagcgagcatagttgcttaaagactcacaggaggacttattttcgcaaaaaaacatgcgagtgcaaccaatgtgaaaaagctttccgtaaaccctcaatctttacactgcataagaaaaccgacataggcgaagaacttcctaattgcaaccagtgcgagactgctttttcccagcatctgcatctcgtgtgcaagaagacttcacagaacctgcaccttgtgtgtaagaagacacatacacaggaaaaaccatataagtgcagcgattgtgaaaaagggcttcctagctcttctcacttgagggaatgcgtcaggatctacggtggcgagcggccttacactcataaagagtacgtggaaaccttctcccattcaacggcgctgtttgtacacatgcaaactcaagatggcgaaaaattttacgagtgtaaagcatgcggcaagcccttcacagaaagctcctatctaacacagcacctcagaactcactccagagtccttcccatagaacacaagaagttcggcaaagcatttgcctttagccccgatcttgctaagcatattcgactcagaaccaggggaaagcattatgtgtgtaacgagtgcgggaaggaatttacgtgtttttcaaagctcaatatacacatccgagttcataccggtgaaaagccgtatgaatgtaacaaatgtgggaaggcgttcaccgattcatcaggcctaataaagcatcggcgtacacacacgggtgagaagccctatgaatgtaaggagtgcgggaaggcatttgcaaactcctcccacctgaccgtgcacatgcgcactcataccggagagaagccttaccagtgtaaagagtgtggcaaagcatttatcaactccagctcgttcaagtcccacatgcagactcatcccggagttaagccatacgactgtcagcaatgtggcaaggccttcatccgctcgagtttcctaattcgacatctccggagccacagcgccgaaaggccatttgagtgtgaggaatgtggtaaagctttccggtactctagtcacctgagccagcataagcggattcacacaggcgagagaccttacaagtgccaaaagtgcggtcaggcgttctctatctcttccggacttaccgtccatatgcgtacacataccggcgaacggccatttgagtgtcaggagtgtgggaaggctttcacgagaagtacctatctgattaggcaccttaggagtcatagtgtggagaagccttacaaagagtgtggccagaccttctcaaacagtagctgcctgacagaatgcgtatag

SEQ ID NO: 25488 - DNA, 2373 bp, Artificial Sequence
  Description of Artificial Sequence: Synthetic coding sequence
atggcttattgtttgaccaactgctaccagtacagcgtgactttcgaagatacagccgtcgacttcacccaggaagaatggatcttactggaccccgttcagcgtaacctgtacagggatgtcatgttggaaaactacgagaatgtggcaaaggtaggcttccagctctttaaacctagcgtgatttcatggctggaggaggaggagcttcggacgctccagcagggcgttctacaggattgggcaattaagcaccagacctcggttagtgccctgcagcaggaattttggaaaatccaaaccagcaacggaattcagatggacctcgtcacgtttgacagcgtggctgtggaattcacacaggaagagtggactctgctcgacccagcacagcgaaacctatacagtgatgtgatgctcgaaaactataagaacctgtcttcagtcggctatcagcttttcaagccctcacttatcagctggctggaggaggaggaagagctgagcacgctgcccagagtcctgcaggagtggaagatgtgcctcaagaccaaaggacctgccttgtggcaggacaacttttgtctcaaaaccctcaatgggattcagttggctcggaaccaaaacggtgaggagttatacgattgcaaacaatgtgaagatgttttctgcaagcacccctgcttaaagacgaacatgagcacacaaaatcgtgggaatacctccgagtgcattcagtatgccaaagacctgttatccttgtacaacaagacatcaaccatccgtaaggtgtccgtgttctctaagcacggcaagagctttcggctcatcctgaacgtccaggtgcagaggaaatgcacacaggacaagtcgttcgagggcaccgactacgggaaagccttcatttatcagtcgtatttagaggcccatcgcaagacacaatctggcgaaaagcttaatgagtggaaacagtgcggcgaggctttcacccattcaacttctcacgcggtcaacgtggagacccatattattaaaaatccgtatgagtgtaaagagtgtggaaaagactttaggtaccccactcatctgaacaaccacatgcaaacacatatcggaatcaaaccttacaaatgtaaacactgcggaaaaacctttactgttccaagtgggttccttgagcatgtaagaacgcacaccggcgagaagccctacggatgtaaggaatgcgggaaggcttttgggaccagcgctggcctgatcgagcacattcgctgtcacgcacgtgagaaaacatttaagtgtgatcactgcggtaaagccttcattagctaccctagcttattcgggcaccttcgagtgcataacggagagaagccttacgagcacaaggagtatggcaaggcattcggtacgtcctcaggggtaatagaggacagacgatccaacacaggacagaagcgtttcgactgcgaccagtgcgggaaagtgttcgtcagttttagttcgctgttcgcccacctcagaacacacaccggggaaaagcccttcaagtgttataagtgcggcaagccctttacctctagtgcctgtttgcgaatccacatgaggactcatacagaggagagactgtatcagtgcaagaagtgcggaaaggcttttaccaaatgtagctatctgaccaaacacctgcggacgcacgcgggtgagaaaccttatgagtgcatgaaatgtggaaaagcatttaccgaaaggagctatttgacgaagcatctcagaaggcacagcggtgagaaaccgtatgagtgcaagaaatgcggtaaagctttcactgagagaagcgaccttactaagcacctccggaggcatacaggagataaaccgtacgagtacaaagattgtggaaaggcttttgttgtgagttctagcctggtcgatcatctgcgcactcacaccgggtacaaaccctacaagtgcaacgcctgcgagaaggcttactcccgaagctgtgtgctgactcagcacctaaagacacatgccgcagagaagacctctgagtgtaacgcctgcggcaattcattcaggaattccatgtgctttcatgatagactcaagaccctgacgaagatcaaaccctataaatgcaaggattgcggtaaagcgtttacatgccactccgatcttactaatcatgtgcgcatccacacaggagagaaaccctataagtgtaaagaatgtgggaaagctttcagaacatcctcaggtcgtatccagcacctgcgaacgcatatgggggagaagccttttgagtgtgatcagtgtggaaaagcattcgctagtttctctgcccgaattgctcacttgaagacccactag

SEQ ID NO: 25489 - DNA, 1461 bp, Artificial Sequence
  Description of Artificial Sequence: Synthetic coding sequence
atggccgcaatctatttgtcacgtggctttttttcacgagaaccaatttgcccgtttgaggaaaaaaccaaggtcgagcgaatggtggaggattatctcgccagcgggtaccaagattcagtaacattcgacgacgtcgcagtggacttcaccccagaggagtgggctcttcttgacacaacagaaaagtatttataccgcgatgtcatgctagagaactatatgaatctggcaagcgttgagtgggaaatccagcctcgaactaagagaagttcactccagcagggtttcctgaaaaaccagattttcagcggcattcaaatgacaagaggctacagcggatggaaattatgcgattgcaaaaattgtggtgaggtgtttagggaacagttttgcctaaaaacgcacatgagggtgcaaaacggcggaaacacctccgaaggtaattgttacggaaaggacactctctccgtccataaagaagcctcgacaggccaggagctgtcgaagttcaatccttgcggcaaggtctttactctaacacccggattggccgtccacttagaggtcctaaatgctagacagccctacaagtgcaaggagtgcggcaagggctttaagtactttgcatcactggacaatcacatggggattcataccgatgaaaagctttgcgagtttcaagaatatggccgtgcggtgaccgcaagctcccacctcaaacaatgtgtggctgtgcataccggaaaaaagtcaaagaaaacgaaaaagtgcggtaaatcctttaccaacttcagtcaactctacgcaccggtgaagacccacaagggtgaaaagtcgtttgaatgcaaagaatgcgggagaagttttcggaatagcagctgcctcaacgaccatatacagattcacacaggcataaaacctcacaagtgcacctattgtggaaaggcctttactagatctactcaactaaccgagcatgtgcggacacatacaggaattaaaccatatgagtgcaaggaatgcggacaggccttcgcccagtattctggcctgagcattcacatcaggtcccattcggggaaaaaaccgtatcagtgtaaagaatgtgggaaagcgtttacaacatcaacttcgctgattcagcatacacgcatccacaccggcgaaaaaccctacgaatgtgttgaatgcgggaaaacgttcatcactagttccagacggtctaaacacctcaaaacccactcaggcgagaagccattcgtgtgtaagatctgcggcaaagcattcctttattcctcccgcctgaacgtgcacctgcggacacacacaggtgagaagccattcgtgtgtaaggagtgcggaaaagctttcgccgtctccagcagactgtctcgtcacgagcgcatccatacaggcgagaagccttacgaatgcaaggatatgtctgtcactatctag

SEQ ID NO: 25490 - DNA, 1053 bp, Artificial Sequence
  Description of Artificial Sequence: Synthetic coding sequence
atgagggtccagaacgggggaaatacaagcgaggggaactgttacggcaaagacaccttaagcgtgcataaggaagcttcaactggccaggagctgtcaaagttcaatccttgcggaaaggtgtttacacttaccccaggcctcgccgtgcacttagaagtgctcaatgccagacagccctataaatgcaaggagtgtggaaagggctttaagtattttgcaagcctggataaccacatgggtattcacaccgatgaaaaactgtgcgagttccaggagtacggaagagctgtgactgcctcctcccatctaaagcagtgcgtcgccgtgcatactggaaagaagagcaagaaaacaaagaagtgtgggaagagtttcactaacttcagccagctgtacgccccagtcaagacacacaaaggcgagaagtcatttgaatgcaaggagtgcggtaggtccttccggaactcttcgtgtctgaatgatcatatccaaatacacacgggcatcaagccccacaaatgtacatattgtgggaaggcgtttactcggagtacgcagcttactgagcatgtcagaacacatacaggcattaaaccctatgagtgcaaagagtgcggccaggcctttgcccagtactcaggcttgtccatacatatcagatctcactctggaaagaagccttaccagtgcaaggagtgcggcaaggcatttacaacttccacgagtttaattcagcacacacggatccatactggggaaaagccctatgagtgcgtagagtgtggcaagacttttattaccagctctcgcaggtccaagcacctcaaaacacactccggggagaaaccctttgtctgtaagatatgtggcaaggccttcctctacagcagccggctgaatgtacacctgcgtactcatactggggagaagccctttgtgtgtaaggagtgtggtaaggccttcgcagtgagcagccggctaagcagacatgagcgaattcacaccggagaaaaaccttatgagtgcaaggacatgagcgtgaccatctag

SEQ ID NO: 25491 - DNA, 231 bp, Artificial Sequence
  Description of Artificial Sequence: Synthetic coding sequence
atggccgctatctacttgagtagggggtttttcagcagggagcctatttgtcctttcgaagaaaaaactaaagtggagaggatggtagaggattacctggcttctggataccaggacagcgtcacttttgatgatgtagccgtcgattttactccagaggagtgggctctcttggacactaccgagaagtacctataccgggatgtcatgttggaaaactacatgaactag

SEQ ID NO: 25492 - DNA, 1254 bp, Artificial Sequence
  Description of Artificial Sequence: Synthetic coding sequence
atgctcgagaactatatgaatctggctagcgtggaatgggagatccaaccaagaacgaagcgcagctctctgcagcaggggtttcttaaaaaccagattttttccggtattcaaatgaccaggggttattcgggctggaagctgtgtgattgcaaaaactgtggagaagtgtttcgggagcagttctgccttaagacccatatgagagtacagaacgggggtaatacctctgagggaaattgctacgggaaagataccctgtcagtccataaagaggccagcaccggccaggaactgagcaaattcaatccttgtggcaaagttttcactctcacacctggtttagcagtacacctcgaagtgttgaacgctcgccagccctacaagtgcaaagagtgtggcaaggggtttaaatatttcgcttcactcgacaaccacatgggcattcacacagacgaaaagttatgtgagtttcaagagtatgggagagctgtgaccgcatcttcccaccttaagcaatgtgtcgcagtgcacaccgggaagaagtcgaagaagaccaagaagtgcggaaagtcctttaccaatttttctcaattgtatgctcctgttaagacacacaaaggtgaaaagagttttgagtgtaaggagtgcggccgaagctttcgcaactcctcgtgcctgaatgaccatatccagatccacaccgggatcaagccccataaatgcacctactgcgggaaggccttcactcgcagtacacagctcacggaacacgtccggacacacactggaataaaaccatatgagtgtaaagagtgtgggcaggctttcgcacagtattccgggctgagtatccacattcggagccactcggggaagaaaccctatcaatgcaaggagtgcggcaaggcctttacaacttcaacatcccttatccagcatacacgtatccatacaggcgagaaaccctatgaatgtgtggaatgcggaaaaaccttcatcactagtagtcggagaagcaaacacctaaagacccactctggtgaaaaaccctttgtgtgtaaaatctgcggcaaggcatttctctatagcagtcgactcaacgtgcatcttcggacgcacaccggcgagaagccgttcgtctgcaaggagtgtggtaaggcctttgcggtgtcctcccggctgtcgaggcacgagaggattcacacaggcgaaaagccctatgagtgtaaggatatgagtgttaccatttag

SEQ ID NO: 25493 - DNA, 126 bp, Artificial Sequence
  Description of Artificial Sequence: Synthetic coding sequence
atggccgcaatttacttgtcccggggttttttctcccgcgagcccatctgcccttttgaagagaaaaccaaagtggaacgaatggtagaggactacctggcctcaggctaccaggattccgtgtag

SEQ ID NO: 25494 - DNA, 1065 bp, Artificial Sequence
  Description of Artificial Sequence: Synthetic coding sequence
atgagcgcttttgacatgtctcatgatttcttcttttgtctcacatcggagtgggagatacagccgcgaaccaagcgaagttccctgcagcagggttttctgaagaatcaaatctttacaggtatccagatgcagacaagatcttacagcgggtggaaactttgtgagaattgtggagaagtgtttagtgagcaattttgccttaagactcacatgagggcccagaacgggggaaatacttttgaggggaactgttacggcaaggattctatttctgttcataaggaggccagtataggtcaggaactgtccaaattcaacccatgtgggaaggtattcacattgaccccaggtctggcagttcacctggagatcctcaacggcaggcagccctacaagtgtaaggaatgcggcaaaggtttcaagtacttcgctagtctagacaaccacatgggcatccacattggcgagaagttgtgcgagtttcaggagtgtgagcgagcgattactaccagcagccacctgaaacagtgtgtggcggtccataccgggaaaaaaagcgagaaaaccaagaattgtggtaagtctttcactaatttttcccagttgagcgcccatgcgaaaacccacaagggcgaaaagtctttcgagtgtaaagaatgcggaagatctttcaggaacagctctagttttaacgtgcacatccagattcacacaggcatcaagccacataaatgcactgaatgcggaaaggcgttcacccgctccacacacctgacacagcacgtccggacacacaccggcatcaaaccttacgaatgtaaggaatgtggacaggcgttcacccaatacacaggcctcgccatccacatccgcaatcatacgggagagaaaccctaccagtgcaaggagtgtggaaaagcctttaaccgcagttcaactctaacccagcaccggaggatccacacaggagagaaaccctatgaatgtgtagagtgtggcaaaacttttatcacatctagtcaccgtagcaagcatctgaagacccactccggtgaaaggtag

SEQ ID NO: 25495 - DNA, 1281 bp, Artificial Sequence
  Description of Artificial Sequence: Synthetic coding sequence
atgtccgcctttgatatgtcacatggcttctttcctcgagaaccaatatgcccatttgaagaaaagacgaagattggaactatggtagaagatcacaggagcaatagctatcaagacagtgtgacctttgatgacgttgctgtggagttcactccagaggagtgggccttgctggacaccacccagaagtatttgtatcgcgacgtcatgcttgaaaattatatgaatctggcctctgtggactttttcttctgccttaccagcgaatgggaaattcagccgaggacaaaaagatcctctctccaacagggcttcttaaagaaccagatctttactggtattcagatgcaaacaagatcatactctggatggaagctctgtgagaactgtggtgaggtcttttccgaacagttttgcctgaagacgcatatgcgagctcagaatggcggtaacacattcgaaggaaactgctatgggaaggactcgattagcgtgcataaagaggcttctattggccaggagttgtctaagtttaacccgtgcggcaaggtgttcactctgactcctggcctggctgtccaccttgagatcctgaacggacggcagccctacaagtgcaaggagtgtgggaagggcttcaagtacttcgcttcactggataaccatatgggcatccatattggagagaaattatgtgaatttcaggagtgtgaacgagccattaccaccagctcacatctcaaacaatgcgtggccgtgcatactggcaagaagagcgaaaaaactaagaactgcggaaagtcatttacaaatttctcccagctgtccgcccatgcgaaaactcataagggtgagaaaagctttgaatgtaaggaatgcgggaggagcttccgcaatagttcaagttttaatgtccatatccagattcacaccggtataaaacctcataaatgtactgaatgcggtaaggcattcactcggtccacccatctaacccaacacgtccgcactcacaccggaattaagccgtatgagtgcaaggagtgcggtcaagccttcacccaatatactgggctggcaattcatatccggaatcacactggggaaaaaccctatcaatgcaaagagtgcgggaaggccttcaatagatcgagcactctgacacaacaccgccgaatccatacaggcgaaaaaccatatgagtgcgttgagtgcggcaaaacattcatcactagcagtcacagaagtaagcatctgaaaacgcattccggagaaagatag

SEQ ID NO: 25496 - DNA, 1281 bp, Artificial Sequence
  Description of Artificial Sequence: Synthetic coding sequence
atgtcagcctttgacatgtctcacggttttttcccacgcgaaccaatctgtccattcgaggagaagacgaagattggaaccatggtcgaggatcaccgaagtaactcttaccaggactccgtaacattcgatgacgtcgcagtcgagtttacgcctgaggagtgggctctactggacactactcagaagtacttatatagggacgtaatgctggagaattatatgaacctagcaagcgttgacttcttcttttgcttaacctccgaatgggaaatacagcccaggactaaacgctcttccctgcagcaggggttcctgaaaaatcagattttcactggcatccagatgcagacccgctcctattccggatggaagctatgtgaaaactgtggagaggtctttagcgagcaattctgtctcaaaacccacatgagggcacaaaatggtgggaatacctttgagggaaactgttatgggaaagactccatttctgtacacaaggaggccagcattggtcaagagttgtctaaattcaacccttgtggaaaggtcttcaccctcacccctggactggctgtgcacttagagatcctgaatggtcgccagccatacaagtgtaaagagtgtggtaaagggttcaagtacttcgcgtcacttgacaatcatatgggaattcacattggagaaaagttgtgtgaatttcaggagtgtgaaagggcgattactacgtccagtcacttaaaacagtgcgttgcagtgcacaccggaaaaaaatctgagaagacaaagaactgcgggaagagtttcaccaattttagccaactgagcgcacacgccaagacacataagggagagaagtcttttgagtgcaaggagtgcggaagatccttccggaactcgagctcgtttaatgtgcacatacagatccacactggtataaaaccccacaaatgtaccgagtgcgggaaagcctttacccgcagtacacacttgactcagcacgtgcggacacatacggggatcaagccctacgaatgcaaggaatgcggtcaggcatttacgcaatacacagggctggctatacatattcgcaatcacaccggagagaagccttatcagtgtaaggaatgtggaaaggcgttcaaccgcagtagcactctaacacagcaccgacggatccatacgggggaaaagccctacgaatgcgtcgagtgcggaaagacctttatcacttcgtcacatcgtagtaaacacctgaaaacgcacagcggagagcgctag

SEQ ID NO: 25497 - DNA, 1074 bp, Artificial Sequence
  Description of Artificial Sequence: Synthetic coding sequence
atgctggagaattatatgaacctcgcatccgtcgacttttttttttgtctgacaagcgagtgggaaatccagcctcggacgaagagaagcagtctgcagcaggggttcttaaaaaatcagatatttacgggtatccaaatgcaaaccagaagctactctggctggaagctttgcgaaaattgcggagaagttttctctgaacagttctgcctgaagactcacatgcgcgctcagaacggtggaaacacatttgaggggaattgctacggcaaagattcaatctctgtacataaggaggccagtatcggacaggagctttccaagttcaacccctgcggcaaggtgtttacactcactcccggtctggcggtgcacctggaaatcctcaatgggaggcagccctacaagtgcaaggagtgcggtaaaggtttcaagtacttcgcctcactcgataatcatatgggaatccacattggcgaaaaactttgtgagttccaggaatgcgaaagggctattacaacatccagccacctgaagcagtgtgtggcagttcacaccggaaagaaaagcgagaagacaaaaaattgtggaaaatcgtttacaaatttctcccaactctctgctcacgcaaagacccacaaaggagagaaatcattcgagtgtaaagagtgcggacggagcttccgcaactcatctagtttcaacgttcatatacagattcacacaggaatcaaacctcataagtgcacagagtgcgggaaggcctttacgaggtccacgcacttgacgcagcatgtaaggactcatacggggatcaagccttatgaatgcaaggaatgtggtcaggccttcacccagtacaccggacttgctattcatattagaaaccacacgggggagaaaccctatcagtgtaaagagtgcggtaaggccttcaacagatcctcaaccctcacacagcatcggaggatccacaccggcgagaaaccttatgagtgtgtggaatgcgggaagacttttattaccagtagccatagaagcaagcacttgaaaacacactcgggtgagagatag

SEQ ID NO: 25498 - DNA, 933 bp, Artificial Sequence
  Description of Artificial Sequence: Synthetic coding sequence
atgacaaggtcatatagcgggtggaagctctgcgagaactgcggggaggtgttcagcgagcaattctgtttgaagactcacatgagagcacagaacggcggaaacacttttgaaggcaactgctatgggaaagatagcatctcagttcacaaagaggcttccatcggccaggagctgagcaagttcaatccttgtggcaaagtcttcaccctgacacctggcctggccgtgcaccttgagatattgaatggcaggcagccttacaaatgcaaagaatgtggcaagggctttaagtactttgcctctctcgacaatcatatgggtattcacattggcgagaagctctgtgagtttcaggaatgtgagcgagctattaccacaagcagccatttaaagcaatgcgttgccgtgcacactggcaaaaagtctgaaaaaaccaagaattgcggaaagtcctttacaaatttttcacagctgtccgcacacgccaagacacacaaaggtgagaaaagcttcgagtgcaaggagtgcggcaggagctttcgcaactcaagtagcttcaacgtgcacatacaaattcatacaggcataaagccgcacaagtgtacagagtgcgggaaagcctttacccggagcacccatcttacccagcatgtaagaacacacacaggcataaagccttacgagtgtaaggagtgcggccaggcattcactcagtacacagggttagccatacacatccggaatcacacgggagaaaagccgtatcaatgtaaggagtgcgggaaggcgttcaatagaagcagcacgttaacacagcatcgaagaattcatacaggggagaaaccctacgaatgcgttgagtgtggcaaaaccttcatcacaagcagtcatcgatcaaaacatctgaagactcactccggagaacggtag

SEQ ID NO: 25499 - DNA, 1170 bp, Artificial Sequence
  Description of Artificial Sequence: Synthetic coding sequence
atggatagcgtgacgttcgacgatgtcgcagtggagttcacgcctgaagagtgggccttactggataccactcagaagtatctttatcgggatgtaatgctcgagaattacatgaaccttgcttccgtcgacttttttttctgcctgacctcagagtgggaaatccagccccgtacaaaacgcagttcactccaacagggatttttgaagaatcagattttcacgggaatccagatgcaaacacgttcatattcaggctggaagctgtgtgagaattgcggggaagtgttctccgaacagttttgcttgaagacacacatgcgggcacagaatggcggtaacacatttgagggcaactgctacggcaaggacagtatttctgtgcacaaagaagcaagcatcggtcaagaattatccaagtttaacccatgtggcaaagtgtttaccctgacacccggtctcgccgtccacttggagatcttgaatggacgacagccgtataagtgcaaggaatgcggtaaagggttcaaatactttgcctccctcgataatcatatgggaattcacatcggagagaaactgtgcgagtttcaggagtgtgagcgggctataacaacaagctcccaccttaagcagtgtgtggccgtgcacacaggtaagaagagcgaaaaaaccaagaattgcggaaaatcctttaccaacttctctcaattgagtgcgcacgccaaaacacacaagggtgaaaagagctttgagtgcaaagagtgtggtcgatcatttcgcaacagctcgagcttcaatgtgcatattcaaatccatacaggcattaagcctcacaagtgcaccgagtgcggaaaggccttcacgcggagcactcacctgacacagcacgtgcgcacccacacagggatcaaaccttacgagtgcaaggaatgtggacaagcctttacccagtatacagggcttgcaatccacattcggaaccacacaggggagaagccataccaatgtaaagaatgcggcaaagcttttaaccgcagttctaccctaacacagcaccgtagaattcatacaggggagaagccttacgaatgcgtggaatgcggcaaaacatttattacctcctcgcataggtctaaacatctgaaaacccactctggggagagatag

SEQ ID NO: 25500 - DNA, 1431 bp, Artificial Sequence
  Description of Artificial Sequence: Synthetic coding sequence
atggacgctgtggcctttgaagacgtggctgtgaatttcacccaggaggaatgggccctgctaggcccaagtcagaaaaacttatacaggtatgtgatgcaagaaacaattcggaacttagactgtattcggatgatatgggaggagcaaaacaccgaggatcagtacaaaaatccacgcagaaatctgaggtgtcacatggtagagcggtttagcgaatctaaggactcaagccaatgcggggagacatttagtctcatccgggattctattgtgaacaatagcatctgtcctggtgaggacccatgtcagagcgcagaatgtgaagaggtgataatggggcacttgagcctcaattctcacatccgcgtggatagcggccataaaccacatgagtaccaggagtacggcgagaagccccatacacacaaacagcgcggaaaggctttctcatatcaccactctttccagagccggggacgcccacataccggaaaaaaacgctacgaatgcaaggaatgcgggaagacctttagcagtcggaggaatctgaggagacatatggtggtccaggggggaaacaggccttacaagtgtaagctgtgcggcaaagcattcttttggccctcgttactgaggatgcacgaacggacacacaccggtgaaaaaccctacgagtgtaaacaatgttcaaaggccttcccattttactcaagttataggaggcacgaaagaatgcatacgggcgagaagccctatgaatgcaagcagtgtagcaaagcactcccagatagttccagctatatcagacacgaacggacccacacaggcgaaaagccgtacacatgcaagcagtgtggaaaagcattttcagtgagttcttcattgaggaggcacgaaaccactcacagcgccgaaaagccttatgagtgtaaacagtgtggaaaaaccttccatcatctgggaagcttccagattcacatgaagaggcacactggcgatcggcctcataaatgcaagatttgcggtaagggattcgacaggccgtcactagttcgctaccacgagcgcatccacaccggcgagaaaccttatgaatgcaagcagtgtgggaaaacactgagtcacagtagctcctttagacgtcacatgatcatgcacacaggcggtgggccacacaagtgcaaaatctgcgggaaggccttcgtttatccaagtgtatgtcagcgccatgaaaaaagccacagcggagaaaaaccttatgagtgtaagcagtgtggcaaggctctgagccactccagctcgttccggcgacatatggtgatgcacaccggtgacgggcctaacaagtgcaaggtgtgcggcaaagcgttcgtctacccctcggtttgtcaaaggcatgaaaagacccactggcgagagacaatttag

SEQ ID NO: 25501 - DNA, 690 bp, Artificial Sequence
  Description of Artificial Sequence: Synthetic coding sequence
atggacgcggtagctttcgaggacgttgctgtaaatttcacacaagaggaatgggccttgctggggccatctcagaagaatctgtatagatacgtgatgcaagagaccattcgcaatctagattgcattaggatgatctgggaggaacaaaacactgaagaccagtataaaaacccgcgacgaaatctgaggtgtcatatggtggaaagattctccgaaagtaaagattcatctcaatgcggcgagacattcagtctgatccgcgatagcatcgtgaacaactccatttgccctggtgaagatccctgtcagtcagccgaatgcgaggaagtgattatgggtcatttatcactcaatagtcacattcgggtggactctggccataaaccacacgaatatcaggagtacggcgaaaaaccacatacacacaagcaacggggaaaagcgttttcttaccaccacagctttcagtcgagggggagaccgcacacaggcaaaaaaaggtacgagtgcaaagagtgcgggaagaccttcagcagtagacggaacttgagaagacacatggtggtgcagggtggcaaccggccatacaagtttcccatcgaagatatgagggagtgcaccctggggaggaacaggatgaatgtttcgagcgtcctcaagccctgtcttatccctgtgccaatttag

SEQ ID NO: 25502 - DNA, 1662 bp, Artificial Sequence
  Description of Artificial Sequence: Synthetic coding sequence
atggactcagtcgcgtctgaggacgtggcagtcaatttcacactcgaggagtgggcgctgcttgatccaagtcagaaaaaactctaccgcgatgtaatgcgcgagaccttcaggaacctggcctgtgttggaaagaagtgggaagatcaatccatcgaggactggtataaaaaccagggacgcattttgaggaaccacatggaagaagggctgtcagaaagtaaggagtatgaccagtgtggagaggcgttctctcagatactgaatcttaacctgaataaaaaaattcccaccatcgtcaggccatgtgagtgttccctgtgcggaaaggttttcatgcaccattcatccctcagtagacatatcagatcccatcttgggcacaaaccttatgattaccaggaatacggggagaaaccatataaatgcaagcagtgcgggaaggctttcagctcttgtcagtctttccgccgtcacgaacgcacccacacaggagagaaaccgtatgcctgcccggagtgtggaaaagcgttcattagccttccaagcgttcggaggcacatgattaagcacacaggcgacggtccatacaagtgccaggagtgtggcaaagcattcgatcgtccttccctattccaaatacatgaaagaacccatacaggagagaagccgtacgagtgtcaagagtgtgccaaagcttttatctccctaccttcttttcaaagacatatgatcagacacactggggacggcccatataaatgccaggaatgcggcaaagccttcgatcggcctagcctgtttcgtatccacgagagaacccacaccggggagaaaccgcatgagtgcaagcagtgcggaaaggccttcatctcattcaccaacttccagagtcacatgatcaggcacaccggggacgggccatataagtgcaaggtgtgcggcagggcatttatctttccatcatacgtgcgtaaacatgaaagaacgcacactggcgagaaaccatacgaatgtaataaatgtgggaaaactttctccagtagctcgaacgtccgaacccacgaacggacacatacaggcgagaagccatatgagtgtaaggagtgcggcaaggctttcattagcctgccttctgtgcgcaggcacatgattaagcacacgggcgatggcccatacaaatgccaagtatgcggaagagcatttgactgtcccagcagcttccaaattcacgaacgcacacacacgggcgagaaaccatatgaatgccaggtatgtggaaaggctttcatatctctgaaaaggataaggaaacacatgattctgcacactggtgacggaccatataagtgccaggtgtgcggaaaagccttcgactgtccttcctccgtgaggacccatgagcgcactcataccggggaaaagccctacgagtgtaaagaatgtggtaaagcttttaattacgcctctagcatccggatccacgaacgcacccacacaggggaaaaaccttacgagtgtaagcagtgcggaaaaacttttagttatagtagctcatttcaacggcacgagcgcgctcacaatggtgacaaaccctacgttaaaaatgtaggaaaattgagcttcatcacccagccctctaacacctgtgaaaacgagtag

SEQ ID NO: 25503 - DNA, 1260 bp, Artificial Sequence
  Description of Artificial Sequence: Synthetic coding sequence
atggcccaagagagcgtgatgttcagcgatgtctcggtggatttcagtcaggaggaatgggagtgccttaatgatgatcaaagagatctgtatcgcgatgtgatgctagaaaattactcaaatctagtgtccatggctggacacagtattagtaagcccaacgtaatttcctatctggagcaggggaaagagccatggttagcagaccgggagctcactcggggtcagtggcctgtcttggagtccaggtgcgagaccaaaaaactctttctgaaaaaggagatatatgaaatcgagtccacccaatgggaaatcatggaaaagctcacaagaagggacttccaatgctcatcattccgagacgactgggaatgcaacaggcagtttaaaaaagagcttggatcccagggcggtcattttaaccagctggtgtttacgcacgaagacctgcctactctaagccatcacccaagtttcacactgcaacagatcattaatagcaaaaaaaagttctgcgcctctaaagagtaccggaagacattccgtcacggtagccaattcgctactcatgagattatccataccatcgaaaaaccgtacgaatgcaaagaatgtgggaaatctttcagacacccctctaggcttacccaccatcaaaaaattcacaccggaaaaaagcctttcgaatgcaaggaatgcggtaagaccttcatttgcggtagcgatttaacacgacaccatcgcattcacactggagagaaaccatacgagtgcaaggaatgcggtaaggcctttagcagcggctccaacttcactagacaccaacgcattcacacgggggagaagccctacgaatgcaaagaatgtggaaaggccttcagtagtggcagtaatttcactcagcaccagcgaatacatacgggggagaagccctacgagtgtaaagagtgcggcaatgcgttcagccagtcgtcccagttgatcaagcatcagcggatacatactggcgaaaagccatatgaatgtaaggagtgtgagaaggctttccgatcaggatccgacttaacccgacaccagaggattcatacaggcgagaagccctatgaatgtaagatttgcgggaaggcctactcacaatcgtcccagctgatcagccaccaccggattcacacaagcgaaaagccatacgagtaccgtgagtgcgggaaaaatttcaactatgatccccaactgattcagcatcagaatctttactggtag

SEQ ID NO: 25504 - DNA, 1257 bp, Artificial Sequence
  Description of Artificial Sequence: Synthetic coding sequence
atggcccaagagtccgttatgttcagcgatgtgtcagtggacttcagccaagaagagtgggagtgcttaaacgacgatcagcgcgatctgtacagagatgtgatgctcgagaattactcaaacttggtctccatgggccacagtatctcgaaacccaatgttatttcttacctggagcagggcaaagagccctggctcgcagatcgcgagttgacgcgaggacagtggcctgttctagagagtagatgcgagaccaagaagctgttccttaaaaaggagatctatgaaattgagtctacccaatgggagataatggagaaactgacaagacgagattttcagtgttcaagctttagggacgattgggaatgtaatcgccagtttaagaaagaactgggcagtcaggggggacatttcaatcagttggtctttacacacgaggatttgcccactctgtcccaccacccctccttcactctgcagcagataatcaacagcaaaaaaaaattctgcgcaagcaaagaatacagaaagacatttcgacatggctcccagtttgccacacatgagattattcataccattgagaaaccatatgaatgcaaggagtgtggaaagtcttttaggcatcccagccgtctaactcaccatcagaaaattcacaccggaaaaaagccttttgaatgtaaggagtgtggcaaaaccttcatatgtggttccgatttgaccaggcatcaccgcatacacacgggggaaaagccctatgagtgtaaggaatgtggaaaggcattctccagcggcagcaacttcaccaggcaccaacgcattcacaccggggaaaaaccatacgaatgcaaggagtgtggtaaggccttttctagcggctccaacttcactcaacatcagagaatccacactggagagaagccctacgaatgtaaagagtgcggcaatgccttcagccagagctcacagctgatcaaacaccaacggatccacacaggggagaagccctatgaatgtaaagaatgtgagaaagcattccgaagtggctctgatctgactcggcaccagagaatccacaccggggagaaaccttatgagtgcaagatttgcggcaaagcctactctcagtcctcgcaacttatctctcaccataggatccatacatctgaaaagccttacgagtaccgcgaatgtggcaagaatttcaactacgatcctcagttgatacagcaccagaatctctattggtag

SEQ ID NO: 25505 - DNA, 477 bp, Artificial Sequence
  Description of Artificial Sequence: Synthetic coding sequence
atggctcaggagagcgtcatgttctcagatgtgtctgtcgatttttctcaggaagaatgggaatgcctgaatgatgatcagcgggacctgtatcgcgacgtgatgctggagaactactccaatctagtttccatggcaggacactccataagcaaacccaatgtgatctcctatttggagcagggcaaggaaccctggctggcggacagagaactaacacggggtcagtggccagttcttgaatcaagatgcgaaaccaaaaaactgttcctgaagaaagaaatctacgagatagaatccacccagtgggagattatggagaagctcacaagacgggacttccaatgttcttcctttcgcgatgattgggagtgtaatcgacaatttaagaaggagctaggatctcagggtggccatttcaatcagcttgtgtttacacatgaagatctccccactttatcccatcatcccagctag

SEQ ID NO: 25506 - DNA, 1257 bp, Artificial Sequence
  Description of Artificial Sequence: Synthetic coding sequence
atggcacaggagtctgtgatgtttagcgatgtctcagttgatttttcccaggaggaatgggagtgcctcaacgatgatcaacgcgacctatatagagacgtaatgctggagaattatagcaatctggtctcaatgggacattccatctccaagccaaatgtgatcagctatctcgaacaaggaaaagagccctggctggcggaccgcgagttgacaaggggccagtggcccgtgcttgagtcaaggtgtgagacaaaaaagcttttcctgaagaaagagatttacgaaatcgaaagcacgcagtgggaaatcatggaaaaactcaccaggcgagatttccagtgttccagcttccgagacgactgggagtgcaataggcagttcaagaaggagttggggagtcagggcggacattttaatcagctagtatttactcacgaggatctgccaacgttgagccaccaccccagctttaccctccagcaaataatcaattccaagaaaaagttttgcgcatccaaggagtatcgcaaaactttcagacatggcagccagtttgctactcacgagatcattcataccatcgagaagccttatgagtgtaaggagtgtggcaagagctttcgccacccttctcgcttgacacatcaccaaaagattcacacgggtaagaagcctttcgagtgcaaagagtgcgggaaaacattcatttgtggctccgatctcactcggcaccaccgtatccatacaggggagaagccatacgaatgtaaagaatgcggaaaggccttctccagtgggtctaattttactcggcatcagcgtatccacacgggcgaaaagccatatgagtgtaaggagtgcggaaaggcattttcctctggatccaatttcacccagcatcagcggatacatacaggtgagaaaccctacgagtgcaaagagtgtggcaacgcattctctcaaagttcccagttgataaagcatcagaggattcacacaggcgaaaagccctacgaatgtaaagaatgtgagaaggcttttaggtccgggagtgacctgaccagacaccaaaggattcacacaggggaaaaaccctacgagtgcaagatttgcggtaaggcatacagccagtcatcccagctgattagccatcaccgaatccacaccagtgagaaaccatatgagtatagggagtgcggcaagaattttaattatgaccctcagctgattcagcatcagaatttgtactggtag

SEQ ID NO: 25507 - DNA, 1260 bp, Artificial Sequence
  Description of Artificial Sequence: Synthetic coding sequence
atggcacaggaatcagtgatgtttagcgatgtctctgtagatttttcacaggaggaatgggagtgtctgaatgatgatcagcgggatctttacagggacgtgatgttggagaactattccaacttggttagcatggctgggcactccatctctaagcctaatgtcatatcttatctcgagcaggggaaagagccttggctggccgaccgggagctcacacggggtcagtggccagtgctggagtcccggtgcgagactaagaagctgttcttgaagaaagagatttacgagattgagagcacacagtgggaaatcatggaaaaactgactagacgagacttccagtgtagctcatttcgcgatgattgggagtgtaacaggcagtttaagaaggaactgggctctcaagggggacattttaaccagttagtcttcactcatgaggatctgcccaccctaagtcatcaccccagcttcacactccaacagataattaacagcaagaagaagttctgcgcttccaaggaataccgtaaaaccttcagacacggctcacagttcgctacacatgagatcatccacacaatcgagaaaccctacgaatgcaaggagtgcggtaaatcattcaggcatcctagccgcttgacccaccatcagaagattcacactgggaagaagccgttcgagtgtaaagaatgtgggaaaacctttatttgtgggagcgatcttaccaggcatcatcgcattcatactggagaaaaaccatacgagtgcaaggagtgcggcaaggcattctcaagcgggagcaactttaccaggcaccaacgaattcacacaggagagaaaccgtatgaatgtaaagaatgcgggaaagctttctcttcagggtcaaattttacccagcaccagagaatccacactggcgagaaaccgtatgaatgcaaagagtgcggtaacgccttctctcaatcctctcagctgattaagcaccagaggattcacacaggggaaaagccatacgaatgcaaggagtgcgagaaggcattcaggtctgggagcgaccttacgaggcatcaacgcatccatactggcgagaagccatacgaatgtaagatctgtgggaaagcctatagccagtcctcccagctcatctctcatcacaggattcatactagcgaaaaaccgtacgaatacagggagtgcggtaaaaatttcaattacgatcctcagctcattcagcatcagaatctatactggtag

SEQ ID NO: 25508 - DNA, 1935 bp, Artificial Sequence
  Description of Artificial Sequence: Synthetic coding sequence
atgacaagtcagagctcggtaatttccaattcttgtgtcacaatggagcgattgtcacatatgatggagagaaaggcgtggtgttcgcaagagtccgcactgtctgaggaagaggaggacactaccaggcccctggagaccgtgaccttcaaagacgtggctgtggatctgactcaggaggagtgggaacagatgaagcctgcccagagaaacttatatagggacgtgatgctggagaactattctaatctggtgaccgtggggtgtcaggtgaccaagccggacgttatattcaagttggaacaggaagaagagccctgggtgatggaggaagaaatgtttggccgtcactgccctgaggtctgggaagttgacgaacagatcaagaaacagcaggagaccctggtgcggaaggttacatcaatctccaagaagatactcatcaaggaaaaggtgatcgagtgtaaaaaagtggccaagatctttcccctgagtagcgacatcgtcacctctaggcaatcgttctacgactgcgactcccttgataaaggtctggaacacaatctcgatttgctgagatacgagaaaggatgtgtaagggagaaacagagtaatgagtttggcaagcctttctaccactgtgctagttacgtggtcaccccattcaagtgcaaccagtgtgggcaggatttttcccacaaattcgacttaatacggcacgaaagaatccatgcaggggagaagccctacgagtgtaaagagtgcggtaaggccttttcccggaaagaaaacctgattactcatcagaaaatccacacaggcgagaaaccatataagtgcaacgaatgcggcaaggcattcattcagatgtcaaatctcatccgccaccatcgcatacacaccggagaaaagccatacgcctgcaaggactgctggaaggccttcagtcaaaaatcaaacctgatagaacacgaaagaattcataccggagaaaaaccatacgaatgtaaggaatgcgggaaatccttttcccagaagcaaaacctaatcgaacacgaaaagatccacacaggtgagaaaccttatgcatgcaacgagtgcggacgggcattcagcagaatgtccagtgttacccttcacatgaggtcgcacactggcgaaaaaccgtataagtgtaacaaatgtgggaaggcattttctcagtgttccgtcttcatcattcatatgcgttcccacactggcgaaaagccttacgtttgcagcgaatgcgggaaggccttcagccaatcgtcttcgcttaccgtgcacatgaggaaccacaccgcagaaaagccctatgagtgcaaggaatgcggcaaggcctttagcaggaaggaaaatcttatcacgcaccagaagatccacaccggcgagaaaccctatgagtgcagtgaatgcggcaaggccttcattcaaatgagcaatctgatacggcaccagagaattcataccggagaaaagccatacgcctgtaccgtgtgtggcaaagctttctcacagaagagcaacctgaccgagcatgagaaaatacacaccggcgagaaaccataccactgtaatcagtgtggaaaagctttttctcaacggcaaaacctactagagcatgagaagattcataccggggagaagcccttcaagtgtaatgaatgcggtaaggccttttccagaatatcctcactgacgctgcatgttcgctcgcatacgggcgagaagccttatgagtgcaacaagtgcggaaaggccttcagccaatgctctcttctgatcattcacatgcgttcacacacaggtgaaaaacccttcgaatgtaacgagtgtgggaaggcgtttagccaacgggcatccctgagcatacacaaaagaggtcacacgggcgaaaggcatcaagtctactag

SEQ ID NO: 25509 - DNA, 1743 bp, Artificial Sequence
  Description of Artificial Sequence: Synthetic coding sequence
atgaaaccagcacagcgaaacctgtatcgggacgttatgttggaaaactacagcaacctcgtaacagttggctgtcaggttactaagcccgatgtgatcttcaagctcgagcaagaagaagagccttgggtgatggaagaggagatgtttgggagacattgcccagaagtctgggaagtggacgagcagataaagaagcaacaggagacgttggtgcgcaaagttacgtccatctcaaagaaaatcctcattaaagagaaggtgattgagtgtaagaaagtggccaagatcttccccttgtcttccgatattgtcacaagcagacagtctttttatgattgtgacagtctggacaaaggacttgagcacaacttggaccttctgcgctacgagaagggatgtgttagagaaaaacagtccaacgaattcggaaaaccattttatcattgcgccagctacgtagtgaccccattcaaatgcaatcagtgtggtcaggactttagtcacaaattcgatctgattcgccatgagaggattcatgccggagagaaaccatacgagtgcaaagaatgcggtaaggcctttagcaggaaggagaacctgattactcatcagaagattcacaccggcgagaagccttacaagtgtaacgagtgtggaaaggctttcatccagatgtctaaccttatcagacatcacaggatccataccggcgagaaaccctatgcttgcaaagactgctggaaggcattctcccaaaaaagcaatctgatcgagcacgagaggatccataccggggaaaagccttatgaatgcaaagagtgcgggaagtcattctcgcaaaagcaaaatctgattgaacatgagaaaatacacactggcgagaaaccttacgcatgtaacgaatgtggccgtgcctttagccgcatgagcagcgtgaccctgcacatgagatcccacaccggcgagaagccttacaaatgcaacaagtgtggaaaggcctttagtcagtgctcggtctttatcatccacatgaggtctcatacgggcgaaaaaccgtatgtctgctccgaatgtggtaaagccttctctcagtcctctagcctgactgtgcatatgcgtaaccatacagccgaaaaaccgtatgagtgcaaggagtgtggaaaagctttctcacggaaagagaatctgatcacacaccagaagatccacaccggtgagaaaccttatgagtgctctgagtgcggaaaagctttcatacaaatgagcaatctgattagacaccagcgaatccataccggagaaaagccttatgcttgtaccgtttgcggcaaggcttttagccagaagagcaatctaactgaacacgaaaagatccatacaggcgagaagccttaccactgtaatcagtgcgggaaggctttttctcagcggcagaatttactagagcatgagaaaatccatacgggggaaaaaccgtttaagtgtaatgagtgtgggaaagccttctcgcgcatttcgtccctgaccttgcatgtccgatctcatacgggagagaagccttatgagtgcaacaagtgtggcaaagcattcagccaatgtagtctgctgattattcacatgcggtctcacaccggcgagaagccgtttgaatgcaacgagtgcggaaaagcattctctcagagggcttccctctcaattcacaagagaggccacaccggggaaagacaccaggtttattag

SEQ ID NO: 25510 - DNA, 1716 bp, Artificial Sequence
  Description of Artificial Sequence: Synthetic coding sequence
atgaagcccgcacagcggaatctgtatcgggatgtcatgctagaaaactacagcaatctggttacagttggttgtcaggttacgaaacctgatgtgatatttaaacttgaacaagaagaagaaccatgggtgatggaagaagagatgttcgggcgtcactgccctgagccacgacgaggcgagaactgctgcgcttctgaagtgatggcagaagggctcaagtttaaagacgtggtcatctatttttcgcaaaaagaatgggagtgtctacatagtgcacagaaggatctgtaccgcgacgttatgctagagaattacgggaatcttgtgctgctcgggcttagcgacaccaagccgaacgttattagcctcctcgagcagaagaaggaaccgtggatggtcaagagaaaagagaccaaagaatggtgccccgactgggagtttggtagggagaccaagaacctatctccaaaagaaaatatctatgaaatcaggtcacctcagcaggagaaggctagggtgattagagaaatacgatgccaggtggaaagacagcaggggcaccaggagggccacttcaggcccgctgtgatccccttcacttccatgcagtgtaccgctcatcgcgagtaccagtggctgcatactggcgaaaagtcctgcgaatgcagaaagtgcaagaatgcgtttaggtaccagagttgccctatccagcatgagatcatccataacaaagagaaagagcctgaatgtggcgagtgtaggaaaatcttcaattccggatcagatttgattaagcatcaaaccctgcatgagtctaagaaacatagtgagaataataagtgcgcgtttaaccatgactctgggattactcagccccagagcatcaacactggcgagaaaccacacaaatgtaaagaatgtgggaaggcctttaggagcagttcgcagatatctcagcatcagagaatgcatctgggcgaaaaaccctacaagtgccgggaatgcggtaaagcctttccatccacagcccagttaaatctccaccaacgaattcacacggacgagaaatactacgagagcaaagcatgcggcaaagccttcacaagaccctctcatctattccggcatcagagaatacataccggggagaaaccgcataaatgtaaagagtgcgggaaggcattcaggtatgacacccagctgtctctccaccagattatccatacgggtgaacggcgttatgaatgccgcgagtgtgggaaagtttattcctgcgcatcacagctctctcttcaccagcgcatccacacaggtgagaaaccacatgagtgtaaggagtgcggaaaagccttcatttccgactcacacctaatacggcaccagagtgtccatacaggggaaaagccatgcaagtgtaaagagtgcgggaagtcatttcggcgaggcagtgagttaactaggcaccagcgagcacacaccggggaaaagccttatgagtgcaaagagtgcgaaaaagcttttacgtgcagcactgagctggtgcggcaccagaaagtgcacacaggggaacgccctcataagtgtaaggaatgcggcaaggcatttatacgaagatccgaactgacacatcacgagagaagccatactggggagaaaccatacgagtgtaaggagtgcggaaaaccttttggtggcggatctgagctgtcgtag

SEQ ID NO: 25511 - DNA, 1752 bp, Artificial Sequence
  Description of Artificial Sequence: Synthetic coding sequence
atgactagccaatcatctgtgatttctaacagctgcgtgactatggagcggttgagtcacatgatggaaagaaaggcatggtgttcgcaggagagtgctctgtcagaagaagaggaggatactactcgcccactggagaccgtcacctttaaagatgtggccgtcgatctgactcaggaagagtgggaacagatgaagccagcccagcgcaatctctaccgagatgtcatgttggaaaactacagcaatctggtgactgtgggctgtcaggtgactaaaccagacgtaatcttcaagttagagcaggaagaagaaccttgggtgatggaagaggagatgtttggaaggcattgcccagaaccccgacgtggcgagaactgttgtgcatccgaggtcatggcggaggggctcaagtttaaggacgtagtcatctacttctcccagaaagagtgggagtgcctccattcggcccagaaggatctctatcgagacgtgatgctagaaaactacggcaacctggtcctgctggggctgagtgacacgaagcccaatgttatctccctgctggaacagaaaaaagagccctggatggtgaagcgaaaagaaacaaaggagtggtgtcccgactgggagttcggaagagaaaccaaaaacctttcccccaaggaaaatatctacgaaatccgtagcccccagcaggaaaaggcaagagtgataagagaaatcaggtgtcaggtggagcggcagcaagggcatcaggaaggacacttccgcccagccgtcatcccttttacatccatgcagtgcaccgcccatcgcgagtatcaatggctgcacaccggagaaaagagctgtgaatgccgtaagtgtaagaatgctttcaggtaccagagttgcccgatccagcatgaaataatacacaacaaagagaaagaacccgaatgtggtgaatgtcggaagatcttcaactctggctcagatctcatcaaacatcagactctgcatgaatcaaagaaacacagcgaaaataataagtgcgcctttaatcacgatagtggcatcacccaaccccagtccattaacaccggtgaaaaacctcacaagtgtaaagaatgcggcaaagctttccgatcatcttcacagatctctcagcatcagcgaatgcacttgggagagaaaccctataagtgccgcgaatgtgggaaggccttcccctccaccgctcagttgaacctccaccagcggattcacacggatgagaaatattacgagtccaaagcctgcggaaaagcattcacacggcctagccacctgtttagacatcagcgcatccacacgggcgaaaaaccccacaagtgcaaagagtgcggtaaagcattccgctacgacacccagttatcactgcatcaaataatacatactggagaaagaagatatgaatgtcgagaatgcgggaaagtttattcctgtgctagtcagcttagcctccatcagaggatccacacaggcgagaagccacacgaatgcaaagagtgtggtaaagcttttattagtgattcccatcttattcgccaccagtcagtccacacgggtgagaagccatgcaaatgcaaagagtgtggtaagtcattccggagggggagcgaactgacacgacaccaacgagcccataccggtgagaagccttacgaatgtaaggagtgcgaaaaagcatttacttgcagcaccgagcttgtgcgacatcaaaagtag

SEQ ID NO: 25512 - DNA, 1668 bp, Artificial Sequence
  Description of Artificial Sequence: Synthetic coding sequence
atggatagcgtggtgtttgaggacgttgccgttgacttcacgctcgaggagtgggcccttctggatagcgcgcagagggatttgtacagagatgtgatgctcgaaacatttagaaaccttgcaagtgtagacgatgggacacagttcaaagccaatggcagtgtgtcactccaagatatgtacggccaagagaagtccaaggagcagactattcccaactttaccgggaacaactcctgtgcttataccttggagaagaattgtgaggggtatgggaccgaggaccaccataaaaatcttaggaatcatatggtcgatcggttctgcacccataacgaaggaaatcagtacggtgaggccattcaccagatgccggatctcacactacataaaaaagtgtccgcaggcgaaaagccctacgagtgtacgaagtgcaggaccgtctttactcatttgtcctccctaaagcggcacgtgaagtcccactgcggcaggaaggcccctccaggtgaggagtgtaagcaggcctgcatctgtcccagtcacttgcatagtcacggcagaactgacacagaggagaagccatacaaatgccaagcctgtggtcagaccttccagcatccaaggtaccttagtcatcatgtgaagacccataccgccgaaaagacctacaaatgcgaacagtgcagaatggccttcaacggcttcgcttcctttacaagacacgttcgcacacataccaaggatcgtccttacaaatgccaggaatgtggcagagcttttatttatcccagcacatttcaacgccatatgaccacccatactggggagaagccttataagtgccagcattgcggcaaagcgtttacctacccccaggctttccagcggcacgagaaaacacatacaggggaaaagccatacgaatgtaagcagtgtgggaagacatttagctggagtgaaacactgagggtgcatatgagaatccacactggcgataagctatataaatgtgagcattgtggaaaagcgtttacttccagcaggtcattccagggccatctccggactcacacaggagagaaaccatatgagtgtaaacaatgcgggaaggcctttacatggtcaagcacatttcgtgaacatgttcgcattcatacccaggagcagctgtataagtgtgaacaatgtggcaaagcattcacaagttccaggagcttccggggtcatctgcggacccacactggcgaaaaaccgtatgagtgcaagcagtgtggaaagacattcacttggtccagcacttttcgtgaacatgtgcgcatacacacccaggagcaacttcacaagtgcgagcactgcggaaaggcctttacctcatctagggctttccaagggcacttgagaatgcacacaggcgagaaaccgtacgaatgcaagcagtgtgggaagacctttacctggtctagcacattgcacaatcacgtgagaatgcacactggagagaagccacacaaatgcaaacaatgtgggatgtccttcaagtggcatagctcattcagaaaccatctccggatgcacaccggccagaagagccacgaatgtcagtcctactccaaggccttcagttgtcaagtgattctctctaaaaccagcgagtccactcactag

SEQ ID NO: 25513 - DNA, 1674 bp, Artificial Sequence
  Description of Artificial Sequence: Synthetic coding sequence
atggactctgtagtgttcgaggacgtggccgtagattttacactcgaggagtgggcgcttttggactctgctcaacgcgatctgtaccgggacgttatgctggaaacatttcgaaacctcgcatcagtgggctgcgagatgtgggagagaacgaatggctccgtaagcttacaggacatgtacggacaggagaagtctaaagaacagactatccccaacttcactggcaacaactcttgcgcctacactctggagaaaaagcggatcaccagatcaggtgaccagagccagttacccgttaggcgcagaaatcacatggttgataggttttgtacacataacgaaggaaatcaatacggcgaggcaatccaccagatgccagacctaacccttcacaaaaaggtgagcgccggagagaagccctacgaatgcactaagtgtagaactgtgttcacacacttatcgagcctcaagagacatgtgaagagccattgtggtaggaaggctccccctggagaagagtgcaagcaggcctgcatatgccctagtcacctgcactctcacggcagaacagataccgaggagaaaccatacaaatgccaggcctgtggccaaacattccaacaccccaggtacttatcccaccatgtgaagacccataccgctgaaaaaacctataaatgtgagcagtgtaggatggctttcaacggcttcgcctcgttcacccggcacgtacgaactcataccaaagaccggccttataagtgccaagagtgtggtcgggcattcatttacccatccacctttcaacgtcacatgactactcacacaggggagaaaccttacaaatgccagcactgcggcaaagcctttacgtatccacaggcatttcagagacacgagaagacccacactggggagaagccatatgaatgcaagcagtgcggaaaaaccttcagttggagcgagacattaagggtgcacatgcggattcatactggcgataagctgtacaagtgcgagcactgtgggaaggcattcaccagttctcgaagtttccagggccatctcaggacacataccggcgagaagccttatgagtgtaagcagtgcgggaaagctttcacttggagcagtacatttagggaacatgtgcggatccatactcaggagcaactttacaaatgtgagcagtgcggaaaggctttcacttcctcgagatcgttccgaggtcatcttaggacacacacgggagaaaagccatatgagtgtaagcagtgcggtaagacattcacatggtcctccacctttcgtgagcacgtgcggatacacacccaggagcagctgcataagtgcgagcattgtggtaaggcgttcacatcctcgcgagcttttcaagggcacctacggatgcacaccggagagaaaccttatgaatgtaaacaatgcggcaaaacctttacatggtcttccaccttgcataaccatgttaggatgcatacaggcgagaagccccacaagtgcaagcagtgcggcatgtctttcaaatggcactccagctttagaaatcatctgcgtatgcatacgggacagaagtcccatgagtgtcagtcctacagcaaagccttctcatgccaggtgatcctgagcaaaacaagtgagtcgacccactag

SEQ ID NO: 25514 - DNA, 1611 bp, Artificial Sequence
  Description of Artificial Sequence: Synthetic coding sequence
atggcagtgggtctattaaaggcgatgtatcaggagctggtgacgttcagagatgtcgccgtggactttagccaggaagaatgggattgtctggacagctctcaacgccatctctatagcaacgtgatgctcgagaactatagaatcctcgtgagcctgggcctgtgcttttctaaacccagcgtgatactgttactggagcaaggaaaagcaccctggatggttaagagagaactgacaaaagggctgtgttccggctgggagccaatttgcgaaaccgaagaactgaccccgaagcaggacttctacgaggagcatcaatcccaaaagattatcgaaactctgacctcctacaatctggagtactcctctctcagagaggagtggaagtgcgaggggtactttgagagacagcctggcaaccagaaggcatgcttcaaagaggaaattatcacacacgaggaaccactgtttgatgagagggagcaggagtacaagtcgtggggttccttccatcagaaccctctgctctgtactcagaagatcatccccaaagaggagaaggttcataagcacgacacccagaaaaggtccttcaaaaaaaacctcatggctatcaagcctaagtccgtatgtgccgaaaagaaacttctcaagtgcaatgactgcgagaaggttttttctcaaagctccagcctcacgttgcatcagaggattcacactggcgaaaagccttataaatgtatcgagtgcgggaaggcattttctcaacgttcaaacttggtacagcaccagcggatccatacgggagagaagccttacgaatgcaaagagtgcaggaaagcatttagtcagaacgcacacctggtgcagcatctgagagttcacactggtgagaaaccctatgagtgcaaagtgtgtaggaaggcattttctcagtttgcgtatctcgctcaacaccagagagtgcatactggcgaaaaaccctatgaatgtattgaatgtggtaaagcattttctaatcggtcttctatagcccaacatcagcgggtccacacaggtgaaaaaccatatgaatgcaatgtatgcggtaaagcgttctcactccgagcttatttgaccgttcaccagcgaatccacacgggggaacggccttatgagtgcaaagaatgcggaaaagccttctctcagaactctcaccttgcccagcatcagaggattcacacgggggaaaagccctataagtgccaagagtgccgcaaggccttttcccagatagcatatcttgctcagcaccaacgcgtccacaccggcgaaaaaccctatgagtgcattgagtgcggcaaggcattttctaacgactcaagcctaacccagcaccaacgtgtgcacaccggcgagaagccttatgaatgcactgtctgcggaaaggctttctcttattgcgggagccttgcccagcaccagaggattcacaccggcgaaagaccctatgagtgcaaggagtgtaaaaagaccttccgtcagcatgctcacctggcccaccatcagcgcattcatatcggcgaaagtcttagcccgcctaacccagtcaaccaccaggtcttgtag

SEQ ID NO: 25515 - DNA, 1002 bp, Artificial Sequence
  Description of Artificial Sequence: Synthetic coding sequence
atggctattaaacctaaaagtgtgtgcgccgaaaaaaaactgctgaaatgcaacgattgtgaaaaggtgttctcacagtcaagcagtctgacactgcatcaacggatccacacgggcgagaaaccgtacaagtgtatcgagtgtggcaaagctttctctcagcgctctaacttagttcagcatcaacggatccacacaggggagaagccctacgaatgtaaggaatgtaggaaggcattttcacagaacgcccacctggtccagcacttaagagttcatactggagaaaaaccatatgagtgcaaagtttgtaggaaggccttctcgcagtttgcctatctggcccagcaccagcgcgtccatacaggagagaaaccatatgagtgtattgagtgtggaaaggccttctctaatcggagttctatcgcccagcaccagcgggttcataccggggagaagccttacgagtgtaacgtatgtggcaaagcattttctcttcgggcttacctgaccgtgcaccaacggattcatacgggggagagaccctacgaatgcaaggaatgcgggaaggccttctctcagaattcccacctggcccaacaccagaggattcacacaggggagaaaccatataaatgccaggaatgcaggaaagcgttcagtcaaatagcatacctggcacagcaccagcgtgtacacaccggggagaagccctacgaatgtattgagtgcgggaaggccttttccaatgacagctcactcacccagcatcagcgggtgcatacaggagaaaagccgtacgagtgcaccgtatgcggaaaagctttctcatactgtgggtcattagctcagcaccagaggatccatacaggcgaaaggccttacgaatgcaaggagtgtaaaaaaaccttcaggcagcacgctcacttggctcatcaccaaaggatccacatcggagagtcacttagcccgccaaatcccgttaaccatcaggttctgtag

SEQ ID NO: 25516 - DNA, 1830 bp, Artificial Sequence
  Description of Artificial Sequence: Synthetic coding sequence
atgccgcatctgctggtgactttccgagacgtagccattgatttttcccaagaagagtgggaatgtcttgatccggctcaacgggatctgtatagagacgttatgcttgaaaattactctaacttaattagtcttgatctggaaagcagctgcgtgacaaagaagctatcccccgagaaggaaatctacgagatggagtccctgcaatgggagaatatgggcaaaagaattaatcaccatctgcagtacaatgggctaggcgacaacatggaatgtaaggggaatcttgaagggcaggaagccagtcaggagggcctgtacatgtgcgtgaagattacgtgtgaggagaaggccacagaatcccactccaccagttccacgttccatcggatcattccaactaaggaaaaactatacaaatgtaaggaatgtagacagggcttctcctacctgtcctgcttgattcagcacgaagaaaatcacaacatcgagaaatgtagcgaagtaaagaaacatcgtaacaccttctctaagaagcctagttatatacagcaccagcggattcagactggcgaaaagccttatgagtgcatggagtgtggcaaagccttcggcaggacctccgatctaattcaacaccaaaaaattcacaccaacgagaagccttaccagtgcaacgcgtgcggcaaggctttcattagggggtctcagctcaccgagcaccaacgggtgcacacgggagagaagccctatgaatgcaagaaatgtgggaaggccttttcatactgcagtcagtacaccttgcaccagcggatccattcaggagagaaaccgtacgaatgcaaggactgcgggaaggcgttcattcttggttcacaattaacctatcaccagagaattcactcaggtgagaagccttatgaatgcaaggaatgtgggaaggctttcatcctcggctctcacctgacttaccatcagagggttcacaccggtgaaaaaccttatatctgcaaggaatgcggtaaggcctttttgtgcgcctctcagctgaatgagcatcagaggattcacacaggggaaaagccatacgagtgcaaggagtgcgggaaaaccttctttcgaggtagccagcttacgtatcacctccgggtccacagtggggaacgaccatacaaatgcaaggagtgtggcaaagcttttatctctaatagcaatctgatccagcaccagcgtatccacaccggagaaaagccttacaaatgtaaggagtgcggcaaagcattcatctgtgggaagcagctctccgaacaccagcgaatccacacaggggagaagcctttcgagtgtaaggaatgcggaaaggccttcattagagtggcttacctgactcaacacgagaaaatccatggcgaaaaacactacgagtgtaaagagtgtgggaagacattcgtcagagctacacagctgacctatcatcagagaattcataccggagagaaaccttacaaatgtaaagagtgcgacaaggcattcatctatggcagtcaactgtccgagcaccagcgcatccatagaggtgaaaaaccctacgagtgcaagcagtgtggcaaggccttcatccggggaagccacttaactgagcatcttcggacacacacgggtgagaagccttacgagtgcaaagaatgtgggcgagccttcagcagaggctcagaacttaccctgcaccagcgaattcacacaggtgagaaaccatacacctgcgtgcaatgcgggaaagacttcagatgcccctcgcagctcacacaacacacacggctacataactag

SEQ ID NO: 25517 - DNA, 1830 bp, Artificial Sequence
  Description of Artificial Sequence: Synthetic coding sequence
atgccacacctccttgtgacctttcgcgatgtggcgatcgacttctctcaggaagagtgggaatgcctggaccctgcccaacgagacttgtatcgcgacgtgatgctggagaattattccaacctgatctcattagatttggaaagttcctgcgtaaccaaaaaactgtctccggagaaggaaatttacgagatggaaagtctgcagtgggagaacatgggtaagcgcatcaaccatcacctccaatataatggacttggggataatatggaatgtaagggaaatcttgagggccaagaggctagtcaggaaggcctctacatgtgtgtgaaaatcacttgcgaggagaaggctactgaatcgcattccacaagcagcacctttcaccggatcatcccgaccaaggaaaagctctataaatgcaaagagtgtagacagggttttagctacctttcctgcctgattcaacacgaagaaaatcataatatcgaaaaatgtagcgaagtgaagaaacatagaaacacattctctaagaagccaagttacatccaacatcagagaatacagacaggagagaaaccctatgaatgcatggagtgcggaaaggcattcgggaggaccagcgacctgattcagcatcagaagattcatacaaacgagaagccatatcagtgtaacgcctgcgggaaggccttcatccgagggtcacagctgactgagcaccagagagtccatactggcgagaagccgtatgagtgtaagaaatgcgggaaggcattctcatactgcagtcaatatacactgcatcagagaatccactcgggcgagaaaccctatgagtgcaaagactgtggtaaggcatttattctaggctctcagctcacttaccatcagcgtatacattcaggtgaaaagccctacgagtgcaaagaatgcgggaaggccttcatcctgggtagccaccttacctatcaccagcgggtgcataccggcgagaagccatatatttgtaaagaatgtgggaaagccttcctgtgcgcctcccagctcaacgagcaccagagaatccacaccggggaaaaaccatatgagtgtaaggagtgcggcaagacattttttagggggagccagctgacataccacctgagagtacactctggagaaagaccctacaagtgtaaggaatgcggcaaggcatttatcagtaactccaacttgatacaacatcaacggatccatactggggagaagccatataagtgtaaagaatgcggaaaagcctttatttgcggaaagcagctgagcgaacaccagcgaattcacacaggtgaaaaaccctttgagtgtaaggaatgcggtaaggcctttatcagggttgcctacctgactcagcatgaaaaaatccacggcgaaaagcactacgagtgcaaagagtgtgggaagaccttcgtgcgcgctacgcagctgacctatcatcagaggatccacacaggcgagaagccttataagtgtaaagagtgtgacaaggctttcatttatggatcacaactgagtgaacaccagagaatccacaggggcgaaaagccatatgaatgtaagcaatgtggtaaagccttcatccgcggaagccatctcactgagcacctgagaacccacaccggggagaaaccctatgaatgcaaagagtgcggcagggccttcagtagagggtctgaactgactctccatcaaaggatccatacaggagagaaaccatacacatgcgtgcagtgtggtaaggattttcgttgtcctagtcaacttacacagcacaccagattgcacaactag

SEQ ID NO: 25518 - DNA, 1830 bp, Artificial Sequence
  Description of Artificial Sequence: Synthetic coding sequence
atgccacacctccttgtcaccttccgcgacgttgcaattgatttctcccaggaggagtgggaatgtctcgacccagcccagagggatctttacagggacgtcatgctggaaaattattccaatcttatcagtctggacctggagagtagctgcgtgacgaagaaattaagccccgaaaaggagatctacgaaatggagtcccttcagtgggagaatatggggaaacgcatcaaccaccatctgcaatacaatggcctcggcgacaacatggaatgcaaggggaatttggagggacaggaggccagccaggagggcttatatatgtgcgtgaagataacctgcgaagagaaggctactgaatcccattctacctcatctactttccaccgcattattcctacgaaggagaagctgtataagtgtaaagaatgcaggcagggctttagctatctcagctgccttattcagcacgaagagaatcacaatattgaaaaatgctcagaggtgaagaagcaccgcaatacatttagcaaaaagccatcatacatccagcaccagcgaattcaaaccggagaaaagccttacgagtgtatggaatgtgggaaagcattcggtcgaactagcgacctaattcaacatcaaaaaatacataccaacgagaaaccatatcaatgcaacgcttgtggaaaggccttcattaggggatctcaactgacagaacaccaaagagtccataccggagagaaaccctacgaatgcaagaagtgcgggaaggcctttagttattgttcccagtacactctgcatcaaagaatccacagcggcgaaaaaccatacgagtgcaaagactgcggcaaagctttcattctcggcagtcagctcacctatcatcagcggatccattccggcgaaaaaccctacgaatgcaaagaatgtggaaaggcctttattctcggctctcacctgacctaccaccagcgcgtccataccggggagaagccgtacatatgtaaagagtgcggtaaggcttttctatgtgcctctcagctaaacgaacatcagaggattcatacaggtgaaaagccttacgagtgtaaagagtgtgggaagactttcttccgcggatcgcagctgacataccacctcagggtccactctggcgagagaccgtataagtgtaaagagtgcggcaaagcattcatctcaaattctaatctgatacaacatcagagaatccacactggcgaaaaaccttacaaatgtaaagaatgtggcaaggcatttatttgcggaaaacagctgtccgagcaccagcgcattcacactggtgagaagcccttcgaatgcaaggaatgcggcaaggccttcatacgggttgcatacctaacacagcacgagaaaattcatggtgagaagcactacgaatgcaaggaatgtgggaagactttcgtccgggcaacgcagcttacgtaccaccagcggatccacacaggggaaaagccttataagtgtaaggagtgcgacaaggcattcatttacggatcacagctcagtgaacaccagcggattcacaggggagagaagccttatgagtgcaagcagtgcgggaaggcattcatccgtggctcccacctgactgagcacttgcgcacccataccggcgaaaagccatacgagtgcaaagagtgtggaagagcattttccagaggctcagagctcacactgcaccaacgtatccatactggggagaagccatatacatgtgttcaatgcggcaaagattttagatgccccagtcagcttacccagcataccagactccacaactag

SEQ ID NO: 25519 - DNA, 1590 bp, Artificial Sequence
  Description of Artificial Sequence: Synthetic coding sequence
atggagcaggagaaaaaactgctggtatccgactccaatagttttatggagcgtgaaagcctaaaatcacctttcacgggggatacaagtatgaacaacctcgaaactgtccaccacaacaactccaaagctgacaagctgaaagaaaagccatccgagtggtctaaacgccacagaccacagcattataagcatgaagatgctaaggagatgccactgacgtgggtgcaagatgaaatttggtgccacgacagctacgagtcggacggtaaaagcgagaactggggcaactttattgccaaggaggaagagaaacctaaccatcaggaatgggatagcggcgaacacaccaacgcctgtgttcaacagaattcctcgttcgtagaccgaccctacaagtgttctgagtgttggaaatcctttagtaatagctctcaccttcgcactcaccagcgcacccattcaggggaaaaaccctacaagtgtagtgagtgtgcaaagtgtttctgcaactcatctcacctgattcagcatttgcgcatgcacacgggggagaaaccgtaccagtgcggcgagtgtggtaagtcattcagcaatactagccatttaatcatccatgaaaggactcatactggcgagaaaccatacaaatgccctgagtgcggcaaacgcttctcaagcagctctcacttgatacagcaccatcgaagccataccggagagaaaccttacgagtgttctgtgtgcgggaaaggcttctcccacagttacgtactgatcgagcatcagaggacccatacaggcgagaagccgtataagtgccccgactgtgggaagagtttcagccagagcagcagcctgattcgccatcagaggacccatacgggtgagaagccttataagtgtctggaatgtgagaagtcttttggctgtaattccacactcatcaaacatcagagaatacacactggggagaagccataccaatgtcccgagtgcggcaaaaatttctcccgttcttcaaatctcattacacatcagaaaatgcatacaggggaaaagtcatacgagagcagtgagtacgaggagagccttggccaaaactgcaacgtgattgaagagtgcaggatacagctgggggaaaagccctataggtgctgtgaatgcgggaaatcttttggcctgtcatcccacctcattagacatcagcgcacccacactggtgagaaaccatacagatgttctgaatgttggaagaccttttcccagagctcaaccctggtgattcaccagaggacacatacgggggagaagccatacaagtgccccgactgtggggaatccttctcacaaagcttcaacctgatccggcatagacgtacacatattggtgagaagccttacaagtgcacttcttgtgagaaatgtttttctcgatccgcgtatctgtcacaacataggaagatacacgttgagaagccatttgagagccccgacgtgggcgatttcccccatgagtggacttggaaaaactgcagcggcgaaatgccctttatctctagcttcagcgtgtccaattcctcctcatag

SEQ ID NO: 25520 - DNA, 1824 bp, Artificial Sequence
  Description of Artificial Sequence: Synthetic coding sequence
atggagtcctgttctgtggcacaggccggtgtccagtggcctgatttgagctcgctgcagcctcctccaccacgctttaagcagttcagctgccattccctacaggtggcaggtatcacagatcttgacttgcagtgtgaaataatcagttatatagaggtgcctacctacgaaaccgacatcagtagcacacagttacagagcatttataaaagggaaaagctttacgagtgtaaaaagtgccagaagaaattcagctcgggctaccaactgatcctacaccacagatttcacgtcattgaaagaccatacgaatgtaaggagtgtgggaagaatttccggtctggctaccagctgaccctgcaccaacgattccacaccggggagaagccttatgagtgtacggagtgcggcaaaaacttccggagcgggtatcaacttacggtgcatcaaaggttccacaccggcgaaaaaacttatgagtgtcgtcaatgtggtaaagccttcatctatgcttctcacattgttcagcacgagcggattcatacaggcggaaagccgtacgagtgtcaggaatgcggacgcgcttttagccaggggggtcatctaaggatccaccagcgtgttcatactggagagaagccctataagtgtaaggaatgcggaaagacattcagtcgcaggagtaaccttgttgagcacggccagttccataccgacgagaaaccgtacatttgcgagaaatgtggcaaggcttttagaagagggcaccaactgactgtacaccagcgggtccatacgggcaaaaagccctacgagtgcaaagagtgtggaaagggctataccactgcctcttattttctcctgcaccagagaatacataaaggaggtaagccttatgagtgtaaggaatgtaagaagaccttcactctgtataggaacctaacacgtcaccagaacatccataccggcgagaagctgttcgagtgcaaacagtgtggaaaaacttacaccactggctcaaagctgttccaacatcagaagactcacaccggtgaaaagccatatgagtgcaaggaatgcggcaaagctttctccctgtacggatatcttaagcagcaccagaagattcatacgggcatgaagcactttgagtgtaaggagtgtaaaaagacttttactctgtaccgtaacctcacgcgacaccaaaatattcacactggcaaaaagctgttcgagtgccaggagtgcgggaaggcttattccaccgggagcaatttaatccaacaccgtaaaacccacacgggggagaagccatataagtgcaaagagtgtggcaagactttctctcttcatggctacttgaatcagcaccaaaaaatccacaccggcatgaagccctacgaatgcaaggtctgccgtaagacttttacattctaccgaaaccttaccctgcaccagtcaatacatacagatgagaagccattcgagtgtaaagagtgcggaaagacatttcgacgctcaagccacctgacggcacaccagagcattcacgctgataagaagccttacgagtgcaaggagtgcggtaaggccttcaaaatgtatggatacctgacgcagcaccagaaaatccacaccgggggaaaaccctacgaatgtaaagagtgcggtaaagcattctcccgggctagtaatctggtccagcatgagcgcattcacacaggtgagaagccttacgtgtgtaaacagtgcggcaagactttcagatacgggtctgcactaaaggcccatcagagaattcaccggagcatcaaagtttag

SEQ ID NO: 25521 - DNA, 1734 bp, Artificial Sequence
  Description of Artificial Sequence: Synthetic coding sequence
atgatcttacgagaggagacacagttcactgacctggatctccagtgcgaaattatttcgtatattgaggtgccgacctacgaaaccgatatctcaagcacccagctgcagagtatatacaaaagagaaaaactctacgaatgcaaaaagtgccagaaaaaattttcatcgggctatcagcttattctgcatcacagattccacgttatcgagcgcccatacgagtgcaaggaatgcgggaaaaacttcagaagtgggtaccagctgactctgcaccagcgcttccatactggggaaaaaccatacgagtgcacggagtgcggtaagaattttcgcagcgggtaccagctcactgttcatcaacggttccacacaggcgaaaagacatacgaatgtcggcagtgcggcaaggcattcatttatgctagccatattgtccagcatgaacgtattcacacaggtggcaaaccctacgagtgccaagagtgtggcagagctttttctcaggggggacacctgcgaatccatcagcgcgtccatacgggggaaaagccgtacaagtgtaaggaatgcgggaagacctttagcaggcgctcaaacctcgtcgagcatggacagttccataccgacgagaagccctacatctgtgaaaaatgcggaaaagcgtttcgcagggggcaccagttgaccgtgcaccaacgtgtccataccggcaagaagccatacgagtgcaaagagtgtgggaagggctataccactgcaagttactttctgctgcatcagcggatacacaaaggcggaaagccatacgaatgcaaagagtgtaaaaaaacctttacactgtacaggaacctgacccggcaccaaaacatccacactggcgaaaagctgtttgagtgtaagcaatgtggcaagacttataccacaggctcaaagttgttccagcaccagaaaacacacaccggtgagaaaccttacgagtgtaaggaatgcggaaaggcattttcgctttacggctacctgaagcagcatcagaaaatacacacagggatgaagcatttcgaatgcaaggagtgcaagaagacttttaccttgtatcggaatctcactcgccatcagaacatccatacaggaaaaaagttattcgagtgtcaggagtgcggcaaggcgtacagcacaggctccaatctgattcagcaccggaaaacgcacactggggagaagccctacaaatgtaaagagtgcggtaagaccttctctttgcacggatatctgaatcagcaccagaagatccacaccgggatgaagccatacgagtgcaaggtttgtcgtaagacattcactttctataggaacctcactttgcaccaaagtatccatacagatgaaaagccctttgaatgcaaggagtgcggaaagaccttcagaagaagctcccacctaactgctcaccaatcaatccatgctgataaaaaaccctacgagtgtaaagaatgcggaaaggcttttaaaatgtacgggtatttaacccagcaccagaagattcacaccggcggaaaaccctacgagtgtaaggaatgcggaaaggccttttctcgcgcaagcaaccttgttcagcacgaacggatccacacaggtgaaaagccttacgtatgcaaacagtgtggcaaaaccttcaggtatgggtcagctcttaaagctcaccagcgtatacaccgatcaatcaaggtatag

SEQ ID NO: 25522 - DNA, 129 bp, Artificial Sequence
  Description of Artificial Sequence: Synthetic coding sequence
atgctcgaaaattataggaatctcgtgagtctgggcggtcactccatcagcaaacccgtcgtggtggacctattggaaaggggcaaggaaccgtggatgatcctgcgggaagagacgcagttcacctag

SEQ ID NO: 25523 - DNA, 1737 bp, Artificial Sequence
  Description of Artificial Sequence: Synthetic coding sequence
atgctggagaactaccgaaacctggtgtccttagacctggacttgcagtgtgaaataatcagttacatcgaagtccctacatacgagacagatatctcgtccacacagctgcagtcaatttataaaagagaaaagctttacgaatgtaagaaatgccagaaaaagtttagcagcggataccaactgatattacatcaccggttccacgtgattgagcgtccgtacgagtgcaaagagtgcggaaaaaacttccgatcagggtaccagctcaccctccatcagagattccataccggcgagaaaccctacgagtgtactgaatgtgggaagaacttcagatccggctaccagctgaccgtccaccaacggttccacaccggggagaagacttacgagtgcagacagtgtggaaaggcgtttatctatgctagtcacatcgtgcagcatgagcggatacacactgggggtaagccctatgagtgccaggaatgcggccgtgccttttctcagggcggacaccttaggatccaccaacgcgtccatactggcgaaaagccctataagtgtaaggaatgtggtaagacttttagccggaggtccaacttagtggaacacggacagttccacacggatgagaaaccttacatatgcgagaagtgtggtaaagcattccggaggggacatcagctgacagttcatcagagagtccacactggcaagaagccctacgagtgcaaggaatgcggcaaggggtatactactgcttcttattttctcttacatcaaaggatccataaaggaggcaaaccctatgagtgcaaagaatgcaagaagacttttaccctttacaggaaccttacacgacaccaaaatattcatacgggggaaaaactcttcgaatgcaaacagtgtggtaagacttacaccactggctccaagctgtttcagcatcagaagactcacacaggagaaaaaccctacgagtgcaaagagtgcgggaaagccttttccctgtacggctacctcaagcagcaccaaaaaatccacaccggcatgaagcacttcgagtgcaaagaatgcaagaagacatttacactatatcggaacctcacacgtcatcagaatatccacacaggaaaaaagctgtttgaatgccaggaatgtgggaaggcctatagcaccgggtctaaccttatccaacaccggaaaactcatacaggggaaaagccctataaatgtaaggaatgcggaaaaactttctccctccatggttatcttaaccagcaccagaagatccataccgggatgaaaccatacgaatgcaaggtatgtcggaaaactttcacgttctatagaaacttgactttgcaccagagtattcacacagatgaaaaacccttcgagtgtaaagagtgtggtaagacttttagaaggtcctcgcatctgaccgcgcaccaatctatccacgccgataagaaaccctacgaatgcaaggagtgtggcaaagcttttaagatgtacggctacctcacccagcaccagaagattcacactggcggaaagccatacgagtgcaaggaatgtggtaaggcattctctagggcatccaacctagttcaacacgagaggatacacactggcgaaaaaccctacgtatgcaaacagtgtgggaagacgttcagatacggtagtgccctgaaggcccaccagaggatccatcggtcaataaaggtctag

SEQ ID NO: 25524 - DNA, 1734 bp, Artificial Sequence
  Description of Artificial Sequence: Synthetic coding sequence
ttcatcctccgcacgagtagtttcgtctcagacctggacctccaatgtgaaataatctcttacatagaggtccctacctacgaaacagacatttccagcacgcaattacagagcatttacaaaagagagaagctgtatgaatgtaagaaatgccagaagaaattcagcagtggttaccagttgatccttcaccataggtttcatgtcattgaacggccatacgaatgtaaggagtgtggaaagaatttccggagcgggtatcagcttactttacatcagcggttccacacaggggagaaaccatacgaatgtaccgagtgtggaaaaaatttcagatcggggtatcagctgaccgtgcatcagcgttttcacaccggggaaaagacctacgagtgtcgccagtgtggtaaagcattcatctatgcaagtcacatcgtgcagcatgagagaatccacacaggcggtaagccgtatgaatgtcaggagtgtggaagggcattttcccaggggggtcacctaagaattcatcagagggtccatacgggagagaaaccttacaagtgcaaggaatgcggcaagactttttctaggaggagtaatcttgtggaacacgggcagtttcacacagacgagaaaccatacatttgtgagaagtgtggaaaggccttcagacgcggacatcagcttactgtgcatcagagagttcatacaggaaagaagccttacgagtgtaaagaatgtggaaaagggtacacgactgcgtcctactttctgcttcatcagaggatccacaagggcggtaagccttacgagtgtaaagagtgtaaaaaaacatttacattgtacaggaacctgacccgtcatcaaaatatccatacaggagaaaagctcttcgagtgtaaacaatgtgggaagacatatacgaccggttcaaaattgtttcaacaccagaagacccataccggtgagaaaccgtacgagtgcaaagagtgtggcaaagctttttcactctacgggtacctaaagcagcatcagaaaattcacactgggatgaaacattttgagtgtaaagaatgcaaaaagacctttacattgtatcgaaatcttacacgtcatcaaaacatccacacaggaaagaagttattcgaatgccaggagtgtgggaaggcctactctactgggtccaatctgattcagcatcggaagacacacactggagagaaaccttacaaatgtaaagagtgcgggaaaaccttcagcttgcacggatacctcaaccagcaccagaagatccatacaggaatgaagccttatgaatgtaaagtgtgcaggaagacttttaccttttacagaaatctgactctgcatcagagtatccataccgatgagaaaccctttgagtgtaaagagtgtggaaagacatttaggcggtcctctcatctcactgcccatcagagcattcatgccgataaaaagccatatgagtgcaaggaatgtgggaaagcgttcaagatgtatggttatctgacgcaacaccagaagattcatacaggcggaaaaccgtacgagtgcaaggaatgtgggaaggctttctccagagcttctaatttagtccagcacgagcgaatccatacgggcgaaaagccctacgtttgtaagcagtgtgggaagacttttcgttacgggagcgctcttaaggctcaccagcgtatccaccgcagcatcaaggtgtag

SEQ ID NO: 25525 - DNA, 1734 bp, Artificial Sequence
  Description of Artificial Sequence: Synthetic coding sequence
atgattctccgtgaggagactcaatttactgacctggatctgcagtgtgagattatatcttacatcgaggtccctacgtacgaaacagacatcagctccacccagctgcagtctatttacaagcgcgaaaagctgtatgagtgtaagaaatgccagaaaaagtttagtagtggctatcagctgattctccaccaccggtttcacgtcatcgaacgaccatatgaatgcaaggaatgtgggaaaaactttaggtccggataccagttgactctgcaccaaagatttcacactggggagaaaccctacgaatgtaccgaatgcggcaagaacttccgatctggctaccagttgacggtgcatcagcggtttcatactggggagaagacttacgagtgtcgacagtgtggcaaagcctttatctacgctagccacattgtacaacacgaaaggatacatacaggaggcaagccttatgagtgccaggagtgcggacgagcctttagccaggggggacatcttcgcatacatcagcgagtgcatactggggaaaagccctataagtgcaaggaatgcggcaaaacctttagccggaggtctaacctggtggagcatggccaattccacacggatgagaagccatatatatgcgaaaaatgtggaaaagctttcaggcggggtcatcagctgacagtgcatcagcgtgtgcacacaggaaaaaagccgtacgagtgtaaggagtgcgggaagggatatacaactgcctcttacttccttctgcatcagcggattcataagggtgggaaaccttatgagtgcaaggagtgtaagaagacctttactctttatcggaacctcacccgtcatcagaatattcatactggagaaaaactcttcgaatgtaagcagtgtggaaagacctataccaccggtagtaagttatttcagcatcagaaaacgcatacgggagaaaagccttacgaatgtaaggaatgcggcaaagctttctcactgtacggctacctgaaacagcatcagaagatacacaccggtatgaagcacttcgagtgtaaggaatgtaagaagacatttaccctgtacagaaatctgacgcgtcatcagaacatacatacaggcaaaaagctgtttgagtgccaagaatgcggtaaagcatactcaacgggctcaaatcttatacagcacagaaagacccataccggcgaaaaaccctacaaatgtaaggaatgtggaaaaaccttctcattgcatggttatttgaatcagcaccagaagatccacaccggcatgaagccttacgagtgtaaagtatgccggaaaaccttcactttctaccggaacctcaccctgcaccagtccatccacactgacgagaaacctttcgagtgcaaggaatgcggcaagaccttccgcaggagcagtcacctgacggcacaccaaagtatccatgccgacaagaaaccatatgaatgcaaagaatgcggaaaagccttcaagatgtacggttacctcactcagcaccagaaaatacacaccggtggcaaaccatacgaatgcaaggaatgcggcaaagcattcagtagggctagcaacctcgtacaacacgagcgcatccatactggcgaaaaaccatatgtctgcaagcagtgtggcaagacattccgctatgggtcagccctgaaagcccaccagcggatacaccggtctatcaaagtctag

SEQ ID NO: 25526 - DNA, 1998 bp, Artificial Sequence
  Description of Artificial Sequence: Synthetic coding sequence
atgtttccagttctggagccccatcaggtgggactcattcggtcgtacaatagcaaaaccatgacatgttttcaagagctcgtgacattcagggatgttgctatagacttctcacgccaggaatgggagtacctggatcctaaccagagagacctataccgggatgtaatgctcgagaattacaggaacctggtcagcctgggcggtcattcaatcagtaagcctgtggtggtggatctgcttgaacggggtaaagaaccctggatgatcctgagagaggagacccagtttactgatctcgacctccagtgcgaaatcatttcatacatcgaagtgcccacatatgagaccgacatcagtagcacccagttacagtccatctacaaacgtgagaagctgtatgagtgtaagaagtgccagaagaagtttagctccggataccagttaatccttcaccacaggttccacgtcatcgaacggccatacgagtgcaaggagtgtggaaagaactttagatcaggctaccagctcaccctacaccaacgcttccacacaggggagaagccttatgaatgtactgaatgtggcaagaattttagaagtggctatcagctcacggtgcatcagcgctttcacaccggcgagaagacctatgaatgcagacagtgcggaaaagcgttcatttacgctagccatattgtacaacatgaaaggatccatactggcggaaaaccatacgaatgtcaggagtgtggacgggctttttcccagggcggtcacctacgcattcatcagcgcgtccatacgggtgagaagccctacaaatgcaaggaatgtggtaagaccttctctcggcgatcaaacctagttgaacatggacagttccatactgacgagaagccatatatctgcgaaaaatgtgggaaggcatttcgtcgagggcatcagttaaccgtccaccagcgcgttcacactggtaaaaaaccttatgaatgcaaggaatgcggaaagggatacaccaccgccagttactttttgctgcaccagaggatacacaaggggggaaaaccgtacgagtgcaaggagtgtaaaaaaacctttacattgtaccggaacttaacaagacaccaaaatatacacactggagaaaaattatttgagtgtaagcagtgcggcaagacatacaccacagggtccaagctgtttcagcaccaaaaaacacacaccggtgaaaagccttatgagtgcaaagagtgcggcaaagcatttagcctctacggctatctgaaacagcatcagaagattcacaccgggatgaagcacttcgagtgcaaggaatgtaagaaaacatttaccctttatcgcaacttgacccgccatcagaatattcataccggcaaaaaactctttgagtgtcaggagtgtggtaaagcctacagtacaggatctaatttgatccagcaccggaaaacacacactggggaaaaaccttataagtgtaaagagtgtggcaagactttttcgcttcatgggtatttgaaccagcatcaaaaaattcacaccgggatgaagccctacgaatgcaaggtttgtcgcaagacttttacgttctataggaatctcaccctccatcagtctatccatacagacgagaagcccttcgagtgtaaagagtgcggaaagacgttcaggcgttcttcccatctgacggcacaccagagcatacacgccgacaagaaaccttacgagtgtaaagagtgcggcaaagctttcaagatgtatggctatcttacccaacaccagaagatacacacaggcggaaagccctacgaatgtaaggagtgcgggaaggccttctccagggccagtaacctcgtccagcatgagaggatccataccggagagaaaccatacgtctgtaaacagtgtggcaaaacatttcgctacgggtcggctctcaaggcccatcagcgaatccatcgtagtataaaagtgtag

SEQ ID NO: 25527 - DNA, 1452 bp, Artificial Sequence
  Description of Artificial Sequence: Synthetic coding sequence
atgtccggcggagggccatcagggggaggtcctggcggttccggccgagctcgaacaagctctttcgcagagccagggggaggaggtggagggggaggtggaggacccggagggagtgccagtggcccaggcggtacaggcggaggaaaagctagcgtgggcgcaatgggaggcggtgtaggcgcatctagctccgggggaggacccggtgggtccggagggggaggcagcggaggacccggagctggaacatctttccctcccccaggcgttaaactcgggcgtgacagcggcaaggtgaccacagtggtggctacattgggccaaggaccagagaggagtcaggaggtggcttatactgacattaaagtgattggtaatggtagcttcggcgtggtctatcaggcccgactggccgaaacccgtgagttggttgcgataaaaaaggtcctccaggataaacgcttcaaaaatcgcgagcttcagattatgagaaagctggaccactgcaatattgtgaggctgcgctattttttctattcaagtggcgaaaagaaggacgaactttacctaaatctcgtgttggaatatgttcctgaaacagtctaccgggtcgctaggcattttaccaaggcaaaactgacaatccctatcctttatgtgaaagtctatatgtaccaactcttccggagcctcgcttatattcattcccagggggtgtgtcaccgcgatattaaacctcagaatcttctggtagatccagacaccgccgtgctaaaattgtgcgacttcggaagtgccaagcagcttgtgagaggcgagccaaacgtgtcatacatatgtagtcgctactaccgcgctccagaacttattttcggggctacggattatactagttccattgacgtgtggagtgccggttgcgtgctagcagagcttctcttgggacagcccatcttccccggagactcaggggtggatcagttagtagagattatcaaggtgttgggcaccccaaccagggagcagatcagagaaatgaatcctaactataccgagtttaaatttccacaaattaaggcacacccatggactaaggtattcaagtcccgaaccccacccgaggccatagcactctgttcatccctgttggagtacaccccctcgagtaggctgtcacccctggaggcgtgcgcccactctttttttgatgagctacgctgcctcgggacacaactgccgaataaccggcctctgccacccctgttcaacttctccgccggagagctcagcatccagccttcactgaacgcgattctcattcctcctcacctgagatcacccgctggtacaaccaccctgacccccagcagccaggccttaaccgagacccccacaagttccgattggcagtctaccgatgctactccgactctgaccaactcaagctag

SEQ ID NO: 25528 - DNA, 2691 bp, Artificial Sequence
  Description of Artificial Sequence: Synthetic coding sequence
atgacagaggaaagcgaggagaccgttttatacattgagcatcgatatgtatgtagcgagtgtaatcagctctatggtagtctcgaggaggttcttatgcaccagaacagtcacgtgccccagcagcacttcgagctggtgggagtggccgacccaggcgtgactgtggcaactgataccgcaagcgggacaggcctctaccagacactggtccaggaatcccagtaccagtgtctggagtgtggccagctgctgatgagtccctcccaactgctggagcaccaagagctgcatctcaaaatgatggccccacaggaggccgtcccagccgagccaagccccaaagccccacccctgtccagctctacaattcactacgagtgtgtagactgcaaagcactgttcgcctcacaggaactttggcttaaccaccgccagacacatctgcgggctacacccaccaaagcaccagcaccggtagttcttggctcacctgtggtgctgggaccacccgtgggccaggccagagtggcagttgagcactcctatagaaaagccgaggaaggaggtgagggtgcgaccgtgccttccgccgcagccactaccaccgaggttgtgactgaggtggaacttcttctctataagtgctctgagtgtagccagctgtttcaactgccagctgactttttggagcatcaggctacacactttcctgcccctgtgcccgagagccaggagcccgctctgcaacaggaagtgcaggcaagttcacctgctgaagtcccggtgagccaacccgatcctctcccggcaagcgaccacagctacgagctgagaaacggggaggctattggccgagaccggaggggcaggcgagctaggcgcaataattccggagaggctggcggagctgctacccaggagttattttgtagcgcttgcgatcagcttttcctctcgccacaccagcttcaacagcacctaaggtctcaccgtgaaggtgtctttaaatgccctctgtgctcacgcgtcttccctagcccctcctcattggaccagcacctgggggaccacagttctgaaagccacttcttgtgtgttgactgcggactggcgttcggcaccgaggctctactcctggcccatcggagggcgcacacccctaacccactgcacagttgtccttgcgggaaaaccttcgtcaatcttactaaattcctgtaccataggcgcactcacggggtgggtggggtccctttgcccaccactcccgtgcccccagaagagcccgtgatcggttttccagagcctgcacctgccgaaaccggggaaccggaagccccagaacctcccgtgtccgaggagacaagcgcaggacctgcagctccaggcacttacagatgtttgctgtgttcacgtgagttcggcaaagcattgcagctgactcgtcatcagcgctttgttcacaggctggagaggcgacataaatgttcaatctgtggaaaaatgtttaagaagaagtctcacgtgcggaatcaccttaggacacacactggtgagagaccattcccttgccccgattgtagtaaaccctttaattcccctgctaacttagctcgccatcgacttacgcacactggtgagcgaccttacaggtgtggcgactgcggcaaagctttcactcagtcatctaccctccggcagcatcgtctggttcatgctcagcacttcccctaccggtgtcaggaatgcggggtgcgattccatcggccttatcggctgttgatgcatcggtatcatcacacaggggaatacccatataaatgtcgagaatgtccacgtagcttcctgctccgtaggctcctggaggtgcaccagctggtggtgcacgccggaagacagcctcatcggtgtccttcatgcggtgccgcatttccatcatcccttcgacttagagaacatagatgtgctgctgcagcggcacaggctcctcggcgattcgagtgtgggacatgtggtaaaaaggtcggatcggccgcaagactgcaagcccacgaggccgcacacgctgccgctgggcctggggaggtactggccaaagaaccacccgctccgcgtgcaccacgggcaaccagggccccagtcgcaagtccagcggcactgggatccacagcaaccgctagccccgctgcccctgcccgtcgcagaggtcttgaatgttccgaatgcaaaaaactcttcagcaccgaaacctcgcttcaggtacaccgtcggatccatactggtgagcgcccttacccgtgtccggattgcggaaaagcttttcgccagagcacccacctgaaagaccacaggaggctacatactggcgaaagaccctttgcttgcgaggtttgcggcaaggcctttgctataagcatgcggctggccgagcaccggaggatacatactggggaaagaccttacagctgtccggattgtggaaaaagctataggagttttagcaacctctggaagcatcgtaagactcaccaacagcagcaccaggccgcagtccgtcaacagctggccgaagcggaggccgcagttggcctcgccgtgatggagactgctgtcgaagcattgcccctggtggaggcaatagagatctatccgctggccgaggccgagggcgtgcagattagcgggtag

SEQ ID NO: 25529 - DNA, 1635 bp, Artificial Sequence
  Description of Artificial Sequence: Synthetic coding sequence
atgtctatgtgggaagatctctgccaaccatatcaagtaccactatcgccagcttatagctggggccgtggatgcccgttgcctacgacacccgtgccccctgaggagccagtgattggtttccccgagccggctcctgcagaaactggcgaacccgaggctcccgaacctcccgtgagtgaggagacaagcgcagggcctgccgctcccggaacctaccgatgtctcttgtgctcacgagagtttggtaaggctctgcaactcactcggcatcagagatttgtccatcgcctcgaaagaagacataagtgctctatctgtggaaaaatgttcaagaaaaaatctcatgtgagaaatcacctcagaacacacactggggaacggccatttccttgcccagactgctccaagccctttaactctccggcaaacctcgcacgacaccgcctgacccacaccggcgagagaccatatcggtgtggtgattgcggcaaagcgtttacacagtcttcaaccctgcggcaacaccgcctcgttcacgcacagcactttccataccgctgtcaggaatgcggggtgcgattccaccgaccctatcgcctgctgatgcatagatatcaccacacaggcgagtacccatacaaatgtcgagagtgccctcgaagcttcttattgcggaggttgctagaagtccaccagctggtggtccacgcaggcaggcagccccatcgttgcccatcatgcggagctgcatttccttcttcgttaaggcttagggagcaccgttgcgccgctgcagccgcacaggccccacggagattcgagtgcgggacttgtggtaaaaaggtggggtccgccgcacgtttgcaggcgcacgaagccgctcacgccgcagcagggccaggagaagtgctagccaaagaacctcccgcacctcgagcaccgagagcaacccgggctcccgtggcttcaccagcagctctgggctctacggcaacagctagccctgcagctccagccagacggagagggctggaatgctcagaatgcaagaaactattcagtaccgagacatctctgcaagtgcatcgcaggattcacacgggagagcggccttacccatgccctgactgcggtaaagcattccgccagtccacacacctgaaagacacaggtgcatgcactcaggtttcgggacccctgcctgtgaaatgcgtagcccgtcctttacctagcccctgcgcatggcagaatattgccgcatcaacccaggcaaacgatccaacgcctgcgttgacagtcgcgcgagctacggcacccagcccaacaagcggaagcacggctaggccaatatcaagctctatcagacagctgtgcggttcttcgtggcagaggcgcaggctccccctcgcatggccgtcttggagactgctctggcgtcgttatccatggtggaagcctctgaggagcacactctggcctcggttacgcggatccaggtcagtggccgactcagcccgattgccgctatggcacttacactccttgttgctgaaagccttacagcaccccttaaaacatctgtatatcctgtgcccatttctcttcccttctccccctccctgcaaattttag

SEQ ID NO: 25530 - DNA, 2691 bp, Artificial Sequence
  Description of Artificial Sequence: Synthetic coding sequence
atgaccgaggaatctgaagagacagtcctgtatatcgaacaccgatacgtatgttccgagtgtaatcagctctacggcagtctcgaggaggtgttaatgcaccaaaattcacacgtaccacagcagcatttcgagctggtgggtgtcgctgacccgggagtcactgtagccacggacaccgcatccggtaccgggctgtatcaaacactggtgcaggaatctcagtatcagtgcctggaatgcggccagctcttgatgagtcccagccaacttctcgaacatcaggagctacaccttaagatgatggcacctcaggaggccgtgcccgctgagcccagtcctaaggctccacccttgtcctcaagcaccatacattatgaatgtgtggattgcaaggctctcttcgcctctcaggaactatggctgaatcatcgccagacacacctacgagctaccccgacgaaagcaccggcacccgtggtgctgggatccccagtggtgttgggtccacccgtgggacaagcgcgtgtcgcggttgaacactcctaccgcaaagctgaggagggcggtgagggggcaaccgtccctagcgccgcagcgaccaccactgaggtcgtgacggaggtggagttattgctgtacaaatgcagtgaatgtagccaactgtttcagctacccgctgactttctggagcatcaggctacgcattttccagcccctgtccccgagtcacaggagcctgccttgcagcaggaagtgcaggcttccagccctgcggaggtccccgtgtcacaaccagacccactgcctgcctccgaccactcctacgaactgagaaacggtgaagccatcgggagagacagacggggacggagggcccgacggaacaacagcggggaagccggtggagcagcaacccaggaactgttctgctctgcttgcgaccagctctttctaagcccccatcagctccaacagcacctgcgttcacacagagagggagtgttcaagtgccccttgtgctctagggtgtttccttcaccaagcagcctcgatcagcacctgggtgatcatagtagcgaaagccactttctgtgcgtggactgtgggcttgcatttggcacggaggccctgctgcttgctcacaggcgggcacacacccccaatccactgcactcatgcccatgtgggaaaaccttcgtaaacttgaccaagtttctgtatcaccgcagaacccatggcgtgggaggcgtgcccctgcccactacccccgtgccacccgaagagccagtgatcggattccctgaacctgctcctgcagaaacaggggagcctgaggcccctgaaccacctgtctctgaggagacatccgcgggacctgcagcgcctggtacgtatcgctgtcttctgtgcagcagagagtttggtaaagccctccagctgacacgacaccaacggtttgtgcaccgcctcgaacgaaggcataagtgctcaatttgtggtaagatgttcaagaagaaatctcacgtgcggaatcacctgagaactcatactggagaacgtccttttccttgcccagattgcagcaagccctttaactcacctgccaacttggctaggcatcgcctcacgcataccggggaacggccatataggtgtggagattgcggtaaggcctttacccaaagtagcacgttgcggcaacaccgcctggtgcacgcgcagcacttcccttaccggtgccaagagtgcggcgtccgcttccaccgaccctaccggctgctcatgcatcgttaccatcatacgggcgagtatccttataaatgcagagagtgtccacgatctttcctgctaaggcgattgcttgaagtgcatcaactggtcgtgcatgctggcaggcagcctcacagatgtccaagctgtggtgccgcattcccttccagtctccgccttcgcgaacatcgatgtgcggcagccgcagcacaggccccacgcagattcgagtgcggcacttgcggcaagaaagtgggctcggcagccagactgcaagcacatgaagccgcacacgccgctgccggaccaggggaggtgctggctaaggagccacccgcaccaagagcccctcgagcgacacgagccccagtggcatcccccgcagctctggggtctactgctaccgccagtcctgctgcaccagcgcgtagacgcggtctggagtgttctgagtgcaagaagctctttagcactgagacctctctgcaggttcatagaaggatacataccggggagcgcccatacccatgccccgactgtggcaaggccttccgccagtccactcacctgaaagatcacagacggctccacacaggtgaacggccttttgcgtgtgaggtctgcggcaaggcattcgcgatttctatgcgtttggctgagcacagacgcattcataccggtgagagaccctacagctgcccagactgcggtaaatcctaccggagttttagtaacctgtggaagcacaggaagacacatcaacagcaacatcaagccgcagtgagacagcagctggcagaagccgaggcagctgttggcctggccgtcatggaaacagccgtcgaggccttgcccttggtcgaggctatcgagatttaccccttggctgaagccgagggtgtccagatatccgggtag

SEQ ID NO: 25531 - DNA, 738 bp, Artificial Sequence
  Description of Artificial Sequence: Synthetic coding sequence
atgctagagagaggggcagaatctgccgctggagcgacagatccttcaccgaccggaaaagaaccagtgaccaaagaggcccctcatcagggcccaccccagaagccctcccaatctgccccaggtccaactgccagtgcaggttcaccccctagacccagacggagaccaccgccacagagaccgcacagatgccctgattgtgacaaggccttctcatatccgtccaaactggcgacccaccgcctggcccacgggggagcccgtcctcacccttgcccagactgcccaaaggctttttcctatccaagcaagctggcagcccacagacttacccacagcggagcccgacctcatccctgtcctcattgtccaaagtcttttggtcataggtccaagctggctgcccacctgtggacgcacgccccaacacggccttatccctgtccggactgcccaaagtctttctgttatccctccaagctcgcagcacacagacacacccaccatgccaccgatgctcggccttacccctgcccacattgccctaaggctttctcttttccaagcaaactggctgcacaccgactgtgtcacgatcccccaactgcacctgggagccaggccacagcttggcataggtgctcctcttgtgggcaggcctttgggcaacggaggctgctgctcctgcaccagagatctcaccaccaggtggaacacaaaggagaaagagattag

SEQ ID NO: 25532 - DNA, 1035 bp, Artificial Sequence
  Description of Artificial Sequence: Synthetic coding sequence
atgtcattagtacccggtctaacgtctattgagcaaccacaaccacagttactcgaccagctgggcattcccaggcggtgctttcaggactgggtggaccaaaacggcctgccaggcctgtcagtgacacagcagattcggggtatcacactgttgaggcgcctcgagtgctctaatacgattattgctcattgccgacacgaactgttaggccctcctacactgagccccagtgcgtggtcttcccccgctagcccacccccacgtgctctgccattgggaagctgcgccagcaaaatgcttgagcgaggcgctgagagcgcagcaggcgcaactgacccttcacccacagggaaggaaccggttacgaaggaggccccacatcaggggcctcctcagaaaccctcgcagtccgctcccggacctactgcctccgcgggttctcccccaagacctaggcgcagaccccctccacagcgtccacatagatgccctgattgcgacaaagccttctcgtatcctagcaaactggcaacacatcgtctagcgcacgggggtgccagaccacacccgtgccccgactgcccaaaggctttttcctatccatcaaagctggccgcacacaggctcactcatagtggagccaggccgcacccatgcccccattgccctaaaagctttggacaccggagcaaattagccgcacacctgtggacacacgcacccacacgaccttatccttgtccggactgcccgaagtccttctgttacccctccaagttggcggctcaccggcatactcaccatgcaaccgacgctcgcccatatccatgtcctcattgcccgaaagcgttttcttttccaagcaagcttgctgctcacagattatgccacgatccccctacggctcccggtagccaagctaccgcgtggcataggtgttcttcgtgtggacaggcgttcgggcagcgcaggctgctgctgctgcaccagcgatctcaccatcaagtcgagcataagggggagagagactag

SEQ ID NO: 25533 - DNA, 513 bp, Artificial Sequence
  Description of Artificial Sequence: Synthetic coding sequence
atggaggatcccaacccagaggaaaatatgaaacagcaggatagccctaaggagcggtcgcctcagagccctggcggtaatatctgtcacctcggagcacctaaatgcaccaggtgcctgattactttcgccgactcaaagtttcaggaaagacacatgaagcgggaacatcctgccgatttcgtggcgcaaaagttacagggggtgttatttatatgttttacctgcgccagatctttccccagcagcaaggccctgataactcatcagcggtcccacgggcctgccgctaaaccaactttaccggttgccactaccaccgctcagccgacttttccgtgccccgactgcgggaagacctttggacaggctgtcagtctacgacgccatcgtcaaatgcacgaggttcgtgcgccacccggaacttttgcatgtaccgaatgtggacaggattttgcccaggaggcaggcctgcatcagcattacatcaggcacgcccgaggcgagctttag

SEQ ID NO: 25534 - DNA, 513 bp, Artificial Sequence
  Description of Artificial Sequence: Synthetic coding sequence
atggaagacccaaatcccgaagaaaatatgaaacagcaagatagccctaaggagcggtctcctcagagcccgggaggaaacatttgtcatcttggagccccaaagtgcaccagatgtctgattacctttgccgatagtaagttccaagagcgccatatgaaacgcgagcatcccgctgactttgtcgcccagaaactgcagggcgtgcttttcatttgcttcacgtgcgcccgatctttcccttcatcaaaagcactgattactcaccagcggtcacatgggccagccgcaaagcccacactgcccgttgcgaccactactgcacaacccacattcccttgcccagactgtgggaaaacgttcgggcaagctgtttcccttcggcgacaccggcagatgcacgaggtacgggcaccgccagggacgttcgcatgcacagaatgtggccaggacttcgctcaagaggccggtttgcaccagcattatatcaggcacgcgcgaggtgagctttag

SEQ ID NO: 25535 - DNA, 513 bp, Artificial Sequence
  Description of Artificial Sequence: Synthetic coding sequence
atggaggatcctaacccagaggaaaacatgaagcagcaggactccccgaaagagcggagccctcagtcccccggtggaaatatttgtcatcttggggctccaaaatgcaccagatgtctgatcacatttgccgatagtaagtttcaggagcgccacatgaagcgggagcaccccgcagattttgttgcgcagaaactgcagggggttctctttatctgtttcacatgcgctagatcgttcccatcatctaaagcgctgatcacccatcagcgttcccacggtccagcagcaaagcctactcttcctgttgcgactaccaccgcacagccaacctttccgtgtcccgattgtgggaagacatttggtcaggccgtcagccttcgtaggcacaggcagatgcacgaagtgcgggctcctccaggtacatttgcttgtaccgagtgcggacaagacttcgctcaggaagccggattgcatcagcattatattcgccacgctcgcggtgaactgtag

SEQ ID NO: 25536 - DNA, 513 bp, Artificial Sequence
  Description of Artificial Sequence: Synthetic coding sequence
atggaagacccaaacccggaggagaacatgaagcagcaggactccccgaaggagcggtccccgcagtctcccggaggaaacatctgccacctcggagcgcctaaatgcaccagatgcttgatcacttttgcggattctaaattccaggagcggcacatgaagcgagaacaccctgcagacttcgtggctcagaagctgcaaggggtgttatttatttgctttacctgtgcgcgttcattcccttctagtaaggctctgatcactcaccagcgaagccatggtcctgcggctaaacctaccctcccagtagccacaaccacagcccagccgacttttccgtgccccgattgcggcaagactttcggccaggctgtatccctaaggagacatcgccagatgcacgaggtaagagctccgcctgggacatttgcctgcactgaatgtggtcaggattttgcgcaggaagccggtctccatcagcactatatccgacacgcaaggggtgaactctag

SEQ ID NO: 25537 - DNA, 513 bp, Artificial Sequence
  Description of Artificial Sequence: Synthetic coding sequence
atggaggatccaaatccagaagagaatatgaaacaacaagatagcccgaaagagaggtccccacaatccccaggagggaatatctgtcatctcggagctcctaagtgcactagatgcctgattacattcgccgattctaagtttcaggagcggcacatgaagcgggagcacccggcagattttgttgcccaaaaactccagggggttctgttcatctgcttcacttgcgctcggtccttcccatcaagtaaagcactgattacgcaccaacgctctcatggcccagccgctaaaccaaccctcccagtggcaactaccacagcccagcccacttttccctgcccagactgcgggaaaacctttggccaggccgtctcacttagaaggcatcgccagatgcatgaagtacgggctccacccggaacttttgcttgcactgagtgcggacaggatttcgcccaagaagcaggactacaccagcactacatccgccatgcaagaggagagctgtag

SEQ ID NO: 25538 - DNA, 513 bp, Artificial Sequence
  Description of Artificial Sequence: Synthetic coding sequence
atggaagatccaaatccagaggagaatatgaaacagcaggactccccgaaagagagatcccctcaatctcctgggggaaatatttgccatctgggcgcacccaaatgcactagatgcctaatcacctttgcagactctaagttccaggaaagacatatgaagagggagcaccccgcagacttcgttgctcagaagttgcagggggtgttgtttatctgctttacgtgcgccaggtcatttcccagttcgaaagcgctcatcacacatcagcggtctcacggccctgccgctaaaccgacccttccagtcgcaacaacaacagcccaacccactttcccttgtcccgattgcgggaagacctttggccaagccgtctccttaagaaggcatcgccagatgcacgaggttagggcacccccaggtacttttgcttgcaccgaatgtgggcaggattttgcacaggaagcgggtctgcaccagcactatattcggcacgcgcgaggcgagctgtag

SEQ ID NO: 25539 - DNA, 1458 bp, Artificial Sequence
  Description of Artificial Sequence: Synthetic coding sequence
atgaaaaacgccactattgtgatgagtgtccgtagagaacagggatcatcgagcggagagggcagcctaagctttgaagacgtggctgtggggttcacacgggaagagtggcagttcctggatcaatcacagaaggttctgtataaagaagtgatgctggaaaactacataaacctggtgtcaatcggttacagaggcacaaagccagattctttgttcaaactggagcagggtgaaccgcctgggatcgccgaaggagcggctcactcccagatttgtcccggttttgtcatccagtccagaaggtatgccggaaaggattctgatgctttcgggggatacggtagatcatgcctgcatataaagcgtgacaagactctgactggcgtcaagtatcacaggtgcgtgaaaccaagtagtcccaagagtcagctcaacgacctacagaagatatgtgccggtggcaagccccacgagtgctccgtctgtgggagagctttctcacggaaggctcaactcattcagcaccagaggacggagcgtggagagaagcctcacggttgcggagagtgtggaaagacgttcatgcgcaagatccaactcacagagcatcaacggacacacacaggagaaaaaccccatgaatgctccgaatgcggcaaagcctttagtaggaaatcgcaattgatggttcatcaaaggactcatacaggggagaaaccataccgatgctcaaaatgtgggaaagcgttctcccgaaagtgtaggctgaatagacaccagagatctcacaccggggagaaactgtatggatgttccgtgtgcggtaaagccttctctcagaaggcctacctgacagctcaccagcgtttgcacacaggggataaaccctacaagtgctctgactgcggtagaactttctattttaagtccgacctcactcgtcaccagagaatccatactggcgagaaaccctatgagtgttccgagtgcgagaaggctttcagaagcaagagtaagttgatccagcaccaacgtacacatacgggggaaaggccatattcatgtagagagtgtggaaaggccttcgcgcacatgtccgtgctcattaagcacgaaaaaacgcacatcagggagactgccataaatagtttgacagtcgaaaagccatcaagtcggtcacacactagcctttatatgagcgagctgattcaggagcagaagactgtaaatactgtccccattgaaatgccatcatccggtacgccaccactccttaacaagagcgaacgcttggtcggaagaaatgttgtgattgtggaacaaccattcccacggaaccaggcctttgtcgttaaccaggaatttgaacagaggatttccctgaccaatgaagtaaatgtggccccttcagtgatcaactacattctttatctcactgatatcgtgtctgagtag

SEQ ID NO: 25540 - DNA, 135 bp, Artificial Sequence
  Description of Artificial Sequence: Synthetic coding sequence
atgaagaatgcgaccatcgttatgtctgtgcgccgtgagcaggggtcctcaagtggtgagggcagcctgagcttcgaggatgtggctgtcgggtttacacgagaggagtggcagtttctggatcagtcacaatag

SEQ ID NO: 25541 - DNA, 177 bp, Artificial Sequence
  Description of Artificial Sequence: Synthetic coding sequence
atgaagaatgccaccattgttatgagcgttagacgtgagcagggcagttccagcggcgaaggatcactgagtttcgaagatgtagccgtcggctttactagggaggaatggcagtttctcgaccagagtcagaaagtgctgtataaagaagtgatgttggaaaattatatcaactag

SEQ ID NO: 25542 - DNA, 189 bp, Artificial Sequence
  Description of Artificial Sequence: Synthetic coding sequence
atgaaaaacgcgaccatagtgatgtctgtcagaagagagcagggttcttcgtctggcgaaggctctttgtcctttgaggatgtcgcagtgggctttacacgagaagagtggcaatttctcgaccagtctcagaaggttctctataaggaggtaatgctcgagaactatataaacctcgtgagcatctag

SEQ ID NO: 25543 - DNA, 1443 bp, Artificial Sequence
  Description of Artificial Sequence: Synthetic coding sequence
atgaagaatgcaactattgtgatgtccgttcgtagagagcagggatctagttctggagagggaagccttagctttgaggatgtggcagtaggcttcacccgcgaagagtggcagttcctggaccagtcacagaaggtgttgtacaaggaagtgatgcttgaaaattacatcaacctggtctccatcggataccggggtacgaagcccgatagcctctttaaacttgaacagggcgaaccacccggaatagccgagggggcagctcattcccagatctgtcctggtttcgtgatccagagccgtcggtatgcaggtaaagactccgatgctttcggcggatacgggagaagctgtctgcatatcaaaagagacaaaacactgacaggcgttaagtatcatagatgtgtgaagccatcatctcccaagagccagctaaatgatctgcagaagatttgtgccggagggaaaccccatgagtgtagtgtgtgtgggagagccttctccaggaaagctcagctcatccaacaccagcggaccgaaagaggggagaagccccatggatgcggcgagtgtggcaagactttcatgcggaaaatacagcttactgagcaccaaagaacacacaccggcgagaagccccacgagtgtagtgagtgtggcaaagccttctccagaaagtcacagttgatggtgcaccagaggacacatactggggagaaaccataccgttgttctaaatgcggtaaagccttctcacgaaagtgccgcctgaaccgccaccagcggtcgcataccggagaaaagctttacggttgtagcgtgtgcggcaaggccttctctcagaaggcatatcttaccgcgcaccagcggctgcacacgggggataagccttacaagtgttctgattgcggccgaacattctacttcaagtcagacctgacacgccatcaacgcatacacacgggggaaaaaccctacgaatgctccgagtgtgagaaagcattccgatccaaatcaaaattgatccagcaccagaggacccacacaggcgagagaccgtacagctgccgggaatgcggaaaagcattcgctcacatgtccgtccttatcaagcacgagaaaacccatatcagagaaactgctataaacagtctgaccgtggaaaagcccagctctaggtcccacacaagtctatacatgtctgaactaatccaggagcagaaaacagtaaatacagttcctattgaaatgcctagttcagggacacctcccttgctgaataagagcgaaagacttgtagggcgtaacgttgtaatcgttgagcagccctttcctcgtaatcaggcgttcgtggtcaaccaggagttcgaacagagaattagcctcaccaatgaagtcaacgtcgctccaagcgtcatcaattacatactgtatctcacttag

SEQ ID NO: 25544 - DNA, 1689 bp, Artificial Sequence
  Description of Artificial Sequence: Synthetic coding sequence
atggacccacaacctcccccaccagctcaggggagcccccctcatagggggaggggtcggggaaggggcagggggaggggtagagggagaggacggggtcggggaggcgcaggggcacccagagctccgttaccctgccccacatgtggacgcctgttcaggttcccttattacctgtctcgacataggctctctcactccggcctcagaccccacgcttgcccattgtgccccaaggcatttcgcaggcccgctcacttaagtcgccatctgcgcggtcatgggccacagccccctctgcgatgcgccgcttgtcctcgcacattccccgagccagcccagctccgcagacacttggctcaggaacacgctggcggtgaggtcgaactggccatcgaaagagtggccaaagagacagctgaaccctcctgggggccacaggacgagggctctgaaccacccacgacagccgcagccggagccacagaggaagaggcagtggcagcgtggcccgagacatggcctgctggggagccttctacccttgctgctcccacctctgccgcagaacctcgtgaatctgagagcgaggaagctgaggctggtgctgccgaactacgcgcagagctggctttggccgctggcagacaggaggagaagcaggtgctgctgcaggccgactggacactgctgtgcctccggtgccgggaagctttcgctaccaaaggcgaactgaaagcccatccttgcctgcgacctgaaggagagcaagagggcgaggggggtccacccccaaggccaaaaaggcaccagtgctctatttgccttaaagccttcgcccgaccttggagtctcagtcgccacaggctggtgcattccactgacagacccttcgtttgccctgattgcggcctggcgtttcgtcttgcgagttaccttcgccaacataggcgggtgcacgggccactgtcattgctggctcccctgcccgcagcaggaaaaaaggacgacaaagccagcggcgcaaggaactcagctaagggccctgaggggggagagggggcagaatgtggtggggcttcagaagggggtgaaggacaaaacggcggagacgcagccccagccagaccgccagccggagaacccaggttttggtgtcctgagtgtggcaaaggattcaggcgtagggcccatctccgccagcacggcgttacacactccggtgctagaccgttccagtgcgtaaggtgccagcgagagtttaagcgattagcagacttggcccgacatgctcaagtacacgccggagggcctgccccacacccctgtccacgatgtccgcgtcggttctcacgtgcatacagcctgttaagacaccaaaggtgccaccgcgcagagttggagcgcgcagcagccctgcaggcgctccaggcccaggccccaactagccccccaccacccccaccaccattaaaggccgagcaggaagaagagggccttcctctacccttagcaaacattaaggaagaaccaccttccccaggaacacctccccagtcccctccagcccctccggtgtttctgagcgcgtcctgcttcgactcccaggatcatagtgcgtttgaaatggaggaggaggaggttgattctaaagcacacctacgcggtttagggggacttgcatcctag

SEQ ID NO: 25545 - DNA, 519 bp, Artificial Sequence
  Description of Artificial Sequence: Synthetic coding sequence
atgctgctcctcccacccagacctccccatccgaggagtagttctcctgaggccatggaccctccaccaccaaaagcgcctccttttcccaaggctgagggtccctcgagtactccctctagtgctgcagggcctcgccctcctcggctcggacggcacctgttgatcgacgccaacggcgtgccctatacctacacggtgcagctggaagaagagcctcgcggaccccctcagagagaagcgcctcccggtgaacccggaccaagaaaaggctactcctgtcccgagtgcgcacgggttttcgcatcccccctccggcttcagtcacaccgggtatcacacagtgatctgaagcccttcacatgtggggcttgtggcaaggcgtttaaaagaagcagccatttatcccggcatagggccacgcacagggccagggccggaccccctcatacatgtccgctgtgtccacggagattccaggacgcagccgaactggcacagcacgttcggttgcactag

SEQ ID NO: 25546 - DNA, 519 bp, Artificial Sequence
  Description of Artificial Sequence: Synthetic coding sequence
atgcttttactgccccctcggcctccccaccctaggagtagttcacccgaagcaatggacccccctcctccaaaggctcctcccttcccaaaggctgagggcccaagctcaacgccttcctctgctgcgggtcccagaccgccacggttaggtcggcatctgctgatcgacgccaatggagtcccctacacgtatactgtacagttagaggaggagccgagaggtcccccacagcgcgaggcccctcccggtgaaccaggacccagaaagggttactcttgtccagaatgcgcaagggtatttgcctccccattgcggctgcaatcgcacagggtgagccacagcgaccttaagccttttacttgcggcgcatgtggaaaggccttcaaaagatcaagtcatctgtcacgccatcgcgcaactcaccgggctcgagccggtccaccccatacctgtcccctgtgtccgcgtagattccaggatgcagctgagctagctcagcatgtacgcttacactag

SEQ ID NO: 25547 - DNA, 519 bp, Artificial Sequence
  Description of Artificial Sequence: Synthetic coding sequence
atgctcctactgcctcctagaccaccacacccaagatctagtagtcccgaagctatggacccgccacccccaaaggcgcctccatttcctaaggcagagggaccatcgtcgactccgagcagtgccgcaggccctcgcccacctcgcctgggcagacacctactgattgacgccaacggagtgccctacacttacaccgtccagcttgaggaagaaccacgtggacccccacagcgcgaggcacctcccggagaacctggcccacggaaaggatacagctgcccagaatgtgctagggtattcgcgagtcctctccgcctacagagccaccgcgtaagtcacagcgatctgaaaccttttacatgcggcgcttgcggaaaggcctttaaacgctctagtcatctgtcaaggcacagagcaacccatagagcaagagcaggccctccacacacatgcccactgtgccctaggcggttccaggacgccgctgagctggcccagcacgttcgtctccactag

SEQ ID NO: 25548 - DNA, 594 bp, Artificial Sequence
  Description of Artificial Sequence: Synthetic coding sequence
atgctcgtcctgccttccccctgccctcaacccctggccttcagttctgtggagacaatggagggccctccaaggaggacttgcaggagccctgaacccggaccttcctcctccattggctccccccaggcgtcttctccaccacgcccaaaccactatctgctcatcgatacacagggtgttccatacacagttctcgtagatgaggaaagccagcgcgagccaggcgcaagtggagctcccggtcagaagaaatgctattcatgtccagtgtgtagccgtgtgtttgaatacatgagttatctgcaaagacactctatcactcattcagaagtgaagccattcgaatgtgacatttgcggtaaagccttcaagagggctagtcatctcgctagacaccatagtatccacttggcaggtggaggtcgcccacatggctgtccactgtgccctcgaagatttagagatgccggagaattagcccagcacagcagagtgcacagcggcgagaggcctttccaatgtcctcactgccccaggaggtttatggagcagaatactctccagaagcatacccggtggaagcacccttag

SEQ ID NO: 25549 - DNA, 1554 bp, Artificial Sequence
  Description of Artificial Sequence: Synthetic coding sequence
atgtcactgggctctgagctctttcgagacgtcgccatcgtcttttcacaggaggagtggcaatggctggctccagcacaaagggacctctacagggacgtgatgttagagacatatagtaacctggtgtctctgggactagcagttagcaaaccagatgtgattagttttctagaacaaggtaaagaaccttggatggtggaaagggtcgtatcgggcggactgtgcccagtgttggaaagcaggtacgataccaaggaattgtttccaaagcagcatgtgtatgaagtggagtcaccgcaatgggagatcatggagagcctgacatcctacggtctggagtgctccagctttcaagatgactgggagtgcagaaatcagttcgacaggcagcaggggaaccccgataggcactttcaccagatgattatacgtcacgaagaaatgccaaccttcgatcagcatgcatctttgactttttatcagaagatccacacccgtgagaagccatttggttataataaatgtcgaaaggacttctggcagaaggagcttctcattaatcaccaaggcatctatacaaacgaaaagccttacaaatgcaaagagtgcgggaaagcttttaaatatggcagtcggctgatccagcatgagaacatccactctggcaaaaagccctatgaatgtaaagaatgcggcaaggcctttaactctggttcgaattttatccagcatcagagggtgcacacaggcgagaagccctacgagtgtaaagattgtgagaaagcattctcacggagctcacagctcatcgagcaccagcggactcacacaggagaaaaaccttaccagtgtaaggaatgtgggaaggccttcaaccgcattagccatctcaaagtgcattacaggatccacactggagaaaaaccgtacgcctgtaaagagtgtgggaagacctttagccaccggagtcagttaattcagcaccagaccgtgcatacaggcagaaagctgtatgaatgtaaggagtgcggtaaggcatttaatcaggggagcaccttaatacgccaccagcggatccataccggggagaagccatatgagtgcaaggtgtgcggtaaggctttcagggtcagctcccaacttaagcaacatcagcgcatccatacaggcgagaagccataccaatgtaaggtctgtggaagggccttcaaaagggtcagccatctgaccgtccattaccgtatccacaccggagagaaaccatacgagtgtaaagagtgtggaaaggctttcagccactgtagccaattgatccaccatcaggtgatacataccgaaaaaaaaccgtacgaatacaaagagtgtgagaagacactgtcacatgattcaactacggtgcagcctcaacggatgcataatcgggaaacccacgtgaacatcattaacgtggaaaagccatctataagcagctaccccctgttgataattcgggagtttatgctggcgtcaaatcacatgaacggctccaatggcgaatcccctctagcttag

SEQ ID NO: 25550 - DNA, 1710 bp, Artificial Sequence
  Description of Artificial Sequence: Synthetic coding sequence
atgtctaaagatctggtcaccttcggagacgtggccgtcaacttctcccaggaagaatgggaatggttaaaccctgcacagcgaaatctctacaggaaagtgatgttggagaattacaggtccctggtgagcctcggggtctcagtctctaagccggacgtcatctcactcctggagcaggggaaggaaccttggatggtcaaaaaggagggcactcgaggcccttgtcccgattgggagtatgtgttcaagaacagtgagttcagttctaagcaggaaacctacgaggagtcttccaaggtcgtgacagtgggcgctaggcacctcagttactcattggactatccttccttgcgggaggattgccaatccgaggattggtacaagaaccaacttggtagtcaggaagtgcacttaagtcagctcataataacccacaaagaaatcctgccagaggttcagaacaaggagtacaataaatcatggcagacgttccatcaggacaccatctttgacattcagcagtcattcccaacaaaggaaaaagcacacaagcacgaaccccagaaaaaatcatatcggaaaaaaagtgtcgaaatgaagcatcgcaaggtgtatgtggagaagaagctcctgaagtgcaacgactgtgaaaaggtctttaaccaaagcagctctctcacactccaccagcgcattcacacaggagagaagccatacgcatgtgtagaatgtggaaagactttctcccagtccgcaaacctagctcaacacaagcgaatccacaccggcgaaaagccctacgaatgtaaggaatgtcgcaaagctttttcgcaaaatgctcacctggcacagcatcaacgcgtgcataccggggagaagccttatcagtgcaaggagtgcaaaaaagcattttcccagattgctcacttgacccaacaccagagggtccacaccggagagcgaccattcgagtgcatcgagtgcggtaaagcattttcgaatggaagttttttagctcagcatcaacgtatccatactggagaaaaaccatacgtgtgtaatgtttgcggtaaggcgttctcgcatcggggatatctgatcgtccatcagcgcatacatactggagaacgcccatatgagtgcaaagagtgcagaaaagcattttcacagtatgcacatctggcacaacatcagagagtccacacaggagaaaaaccatatgagtgcaaagtttgcagaaaagctttctcacagatcgcctaccttgatcagcaccaacgcgtgcacacaggagaaaagccctacgaatgtattgagtgcggtaaggctttcagcaattcgtcttccttggcgcagcaccagagaagccacaccggagagaaaccatacatgtgcaaggagtgtaggaagacctttagccagaatgctggactcgctcagcatcagcggatccacacaggagagaagccatacgagtgtaatgtgtgcggcaaagccttcagctactccgggagcttgactcttcaccaacgaattcacaccggagagcgcccatatgagtgtaaagactgccggaagtcctttcgccaacgggcacatcttgcccatcacgaacggatccatacgatggaatccttcctcaccctttccagcccttctcccagcaccagtaatcagcttcccaggccagtcggctttatttcttag

SEQ ID NO: 25551 - DNA, 1710 bp, Artificial Sequence
  Description of Artificial Sequence: Synthetic coding sequence
atgagtaaggatctggtgacatttggcgacgtggcagtaaatttctcccaggaggagtgggaatggttgaacccagcccaacggaacctctataggaaagtcatgctcgaaaactacagaagtttagtgagtctgggcgtttcagtcagcaagccggatgtcatctctctacttgaacaggggaaagaaccctggatggttaaaaaagaggggactcgaggaccatgccctgactgggagtatgtcttcaagaactctgagttcagtagtaaacaggagacttatgaagagagtagcaaggtggtcaccgtgggtgctagacacctgagttactcccttgattatcctagtctcagggaagactgccagtccgaggattggtacaaaaaccagcttggatcacaggaggttcatctgtcccaactgattataacccacaaagagatcctgcccgaggtgcagaataaggaatataacaagtcttggcagacattccaccaggatactatttttgacatccagcaatcttttccaaccaaggaaaaggcccacaagcatgagccacagaagaagtcctaccggaaaaaaagtgtagaaatgaagcacaggaaagtgtacgtggagaagaaacttctgaagtgtaacgactgtgaaaaggtcttcaaccaatcctcatccctgacactgcatcaacgaatccatacaggagagaaaccttatgcctgtgtggaatgcgggaagactttcagccaatctgctaatctcgctcagcacaagcgcattcatacaggagaaaagccatacgagtgtaaagagtgtcgtaaagccttctcccagaatgctcacctggcacagcatcaacgcgttcatacaggagaaaagccctaccagtgtaaagaatgtaagaaagcatttagtcaaattgcccacctgacacagcaccagcgcgtccacacaggcgaacggccttttgaatgtatcgagtgtggcaaggcattctcaaacggcagctttctggcccagcaccagcgcatacacaccggagagaagccttacgtctgcaacgtttgcggaaaggccttctctcacagaggttatctgattgtgcaccagcgcatacacactggagaaaggccgtacgaatgtaaagaatgtcggaaggcattcagccagtacgcccatctggctcaacaccagagagtacataccggcgagaaaccctatgagtgcaaagtgtgccggaaggcgttttctcagatcgcttaccttgaccaacatcaacgggttcacacgggagagaagccatatgagtgtatagagtgtggtaaggcctttagcaattcctcatcacttgcacagcatcagcgctcacacaccggcgaaaaaccttatatgtgtaaagaatgtcggaagacattctctcagaacgccggactggcacagcaccaaaggatacacaccggagagaagccctacgaatgcaacgtctgtggaaaggccttcagctactctggcagtctgacactgcatcagcggattcacactggcgagcggccttacgagtgtaaagattgtcgtaagtctttcaggcagcgggcacatctcgcgcaccatgagaggattcacacaatggaatcctttctgacactgagttccccatctccgtccactagtaatcagctgccgagacctgttggcttcattagctag

SEQ ID NO: 25552 - DNA, 414 bp, Artificial Sequence
  Description of Artificial Sequence: Synthetic coding sequence
atgtcgaaagacctagtgactttcggagatgtggcagtgaatttcagccaggaagagtgggagtggctcaaccccgctcaaagaaatttgtataggaaggtgatgttggaaaattatcgcagtctggtatcgttaggtgtaagcgtcagtaagccagatgtcatttctctcctggagcagggtaaggagccttggatggttaaaaaggaaggcaccagagggccttgtcccgattgggagtatgttttcaagaatagcgagttctcctccaagcaggaaacttatgaggagagtagcaaagtcgtcacggtcggggctaggcatttgtcttacagccttgactacccttctctcagggaggactgtcagtcagaggactggtacaagaatcaattagggtcacaggaagtatag

SEQ ID NO: 25553 - DNA, 390 bp, Artificial Sequence
  Description of Artificial Sequence: Synthetic coding sequence
atgagcaaggatctcgtgaccttcggtgacgttgcagtgaatttttcacaggaagagtgggagtggctcaatcctgcgcagcgaaacctctataggaaggtgatgctggagaactatcgcagcctggtcagccttggggtttcagtttctaagcccgacgttatctcactacttgaacagggcaaggaaccctggatggtaaagaaagaaggtactcgaggcccatgtcccgactgggagtacgtgttcaagaattccgaattctcttcgaagcaggagacctatgaggagtcatctaaggtggtaaccgttggggctagacacttgtcgtatagcttagactatccatctttacgggaggactgtcaatccgaagactggtacaaatag

SEQ ID NO: 25554 - DNA, 1266 bp, Artificial Sequence
  Description of Artificial Sequence: Synthetic coding sequence
atggccggagaagcagaagcccagctggatccctcgttgcaaggactcgttatgtttgaagacgtcaccgtgtatttttcgagggaggagtggggtctcctaaatgttactcagaagggtctgtatagagatgttatgctcgaaaacttcgcactcgtgagttcgctgggattggctccaagccggtccccagtctttacccagcttgaagacgacgaacagtcttgggttcccagctgggtagatgttaccccggtctcccgcgcagaggccagacgcggattcgggctcgacgggctgtgcagggtggaggatgaacgggctcatccagagcacttaaagagttaccgtgtgatccaacaccaggacacccatagtgagggaaaacctcggaggcataccgagcatggtgctgcattcccaccagggtcctcctgtggacaacagcaggaggtccatgtggctgagaagctgtttaagtgctctgattgcggaaaggtcttcctcaaagctttcgctctgcttgatcacctcatcacgcactcagaagagagaccctttcggtgtcccaccgggaggtcagccttcaagaagtccgcacatattaatcctcgaaagatacataccggggaaactgcacacgtgtgtaatgaatgtggaaaggcattttcctaccccagtaaactcaggaagcaccagaaggttcataccggaattaaaccctttaagtgcagcgattgcggaaagacattcaaccgaaaagacgccctcgtgctacaccagaggatacacacaggcgaaaggccctacgagtgtagcaagtgtgggaaaacctttagcgtcttgtccactctcatccgccataggaaagtgcacatcggcgagcgaccatacgagtgcactgagtgtggcaaattctttaaatacaataatagtttcattctccaccagcgagtccatacaggggagcggccttttgagtgtaaacagtgcgggaagggttatgtcacccggagcggtctgtatcagcactggaaagtccataccggcgaacgcccttacgaatgctctctgtgtggcaagaccttcacaacaaggtcttaccgcaacagacatcagcagtttcacacagaggaaaggagctatgagtgtaccgagtgtggcaaggcattcaagcatagttcaactcttctccaacacaaaaaagtgcatacaccagagcggcgtcaggaagatcgcgctcacgggaaggtggtgtcgtgctag

SEQ ID NO: 25555 - DNA, 438 bp, Artificial Sequence
  Description of Artificial Sequence: Synthetic coding sequence
atggccggtgaggcagagggcctcgtcatgtttgaagacgtgaccgtctattttagtcgagaggaatggggacttctcaatgttactcagaaaggactatacagagacgtgatgctggagaattttgctcttgtgagctcattgggcctggcaccatcccgcagcccagtatttacccagcttgaagatgacgagcaatcctgggtgccttcctgggtggacgttactcccgtgagcagggcagaggcaagacgagggtttggcttgggccctgcatgttcctgcctctccgggctgcggctgctcattgcacttttgtgtatctgcgctgaactcagcacagtgggggactctgttcgcgtgctaaagtgtgcccacattctcaaacagatggtctgcgtggagtggaggatgcgggaaccaatcttatccatttag

SEQ ID NO: 25556 - DNA, 924 bp, Artificial Sequence
  Description of Artificial Sequence: Synthetic coding sequence
ccaggcagcagctgtggacagcagcaggaagtgcatgtggccgagaaattgttcaagtgttctgattgtggcaaagtcttcttaaaagcctttgcactgctggatcatcttattacacatagcgaggagagacccttccggtgtcctactgggagatctgcttttaaaaagtccgcccacatcaaccccaggaagatacacacaggcgagacagcacatgtgtgtaacgagtgtgggaaggctttctcctacccaagtaagctgcggaagcaccagaaagtgcacacaggaattaaacccttcaaatgctcagactgcggaaagactttcaatcgaaaggacgctttggtgctccaccaaaggatccacacgggcgaacgtccatatgaatgttctaaatgcggtaaaactttttccgtgctctctaccctgataaggcatcggaaggtgcacatcggggagaggccttacgagtgcaccgagtgcggaaagttcttcaaatataacaatagcttcatcctgcaccagcgggtccacactggcgaaaggccattcgagtgcaaacagtgcgggaagggctatgttacaagatccgggctataccagcattggaaagtgcatactggtgagcgcccatacgagtgttcgctctgtggaaagacctttaccaccaggagctataggaacagacatcagcagttccacactgaagaaaggagctacgagtgcactgagtgtggcaaggcctttaaacactcttccaccctcctgcagcacaagaaggtccatactccagaaagaccattcatttgttttaattgtgggaaaaacttcaacatgtcaagctgcctggcctggcaccagaaacttcacccaggcgaaaagccatttgactacagcaaatgtcggaaagtttttacttag

SEQ ID NO: 25557 - DNA, 2145 bp, Artificial Sequence
  Description of Artificial Sequence: Synthetic coding sequence
atgttggaaacatattctcatctcttatccgttggatatcaggtgccagaagccgaagttgttatgctggagcagggaaaagaaccttgggccctccagggcgagcggcctcgccagtcctgtcccggtgaaaaactctgggaccacaatcagtgcaggaaaatcctgtcctacaagcaggttagtagccaaccacagaaaatgtatcctggcgaaaaagcctacgagtgcgcaaaattcgagaaaatttttacacagaaatctcagctgaaagtccatctcaaggtgcttgctggagagaagctgtacgtgtgcattgagtgcggcaaggctttcgtacaaaagcctgagtttatcatccatcagaaaacgcacatgagagaaaaaccatttaaatgcaacgagtgcggaaagagcttcttccaggttagcagtctctttcgccaccaacggatccatactggtgaaaaactgtacgagtgtagccagtgtggaaagggcttctcctacaacagtgacttgtctattcatgaaaaaattcatactggtgaacgccaccacgagtgtacggattgcggtaaagcttttactcagaaatcgacgcttaaaatgcaccagaagatccataccggagaaaggagctatatttgcattgagtgcggtcaggccttcattcaaaaaacccacctgatcgcccacagacgcattcatacaggagaaaagccttacgagtgtagtaattgcggtaagtccttcatctccaaaagccagctgcaggtgcaccaaagggtccacaccagagtgaaaccttatatctgtaccgagtatggaaaagtctttagcaataacagcaacctggtcactcataaaaaagtgcaaagcagggaaaagtcctcaatttgcacagagtgtggcaaggcattcacctatcgtagtgagttaatcatccatcagagaattcacactggagaaaaaccatacgaatgtagtgactgcgggaaagcatttacccaaaagtctgctctgaccgtgcaccaacgtattcacacaggggagaagagctatatctgcatgaaatgtggacttgccttcattcagaaggcccatctgattgcccaccagattattcacactggggagaagccccacaagtgtggccattgtggcaagctctttacatcaaaatctcagttacatgtccacaaacgtatccatactggcgagaagccctatatgtgcaacaagtgcggcaaagccttcactaaccggtctaatcttattacccaccagaaaacgcacacaggagaaaagagttacatatgttccaaatgtggaaaagcattcacccagaggtccgacctgattacacatcagcgcatccacacgggagagaagccctatgagtgtaacacgtgcggaaaagccttcacccagaaatcccatctgaacatccaccaaaaaattcacaccggtgaaagacaatatgagtgtcacgaatgtgggaaagcgttcaaccagaaaagcatattgatcgttcatcaaaaaatacacacaggagaaaagccatatgtctgcaccgaatgtggtagagcctttattcgcaaatccaactttataacccatcagcgaattcacaccggtgagaagccctacgagtgctctgactgcggtaagtcattcacgtccaaaagccaactattggttcaccagccagtccatactggggagaagccttatgtatgcgctgagtgtgggaaggcattctccggacgatctaatttaagcaagcatcagaagacacacactggggaaaagccctacatatgcagtgagtgtggcaaaacattccgacagaaaagcgaactgataactcaccacagaatccacacaggtgaaaaaccctatgagtgtagtgattgcggcaagtcctttaccaagaagtcccagcttcaggtacatcaaagaatacacacaggagagaagccatatgtatgcgctgagtgtggcaaggcctttaccgaccgcagtaacttgaacaagcaccagaccactcatactggggataagccctacaaatgcggcatttgtggcaagggctttgtacagaaatccgtgttttcggtgcaccagtcctctcacgcctag

SEQ ID NO: 25558 - DNA, 1221 bp, Artificial Sequence
  Description of Artificial Sequence: Synthetic coding sequence
atgctcgagacttattcgcacctactgtctgtgggctatcaagtgccggaagccgaggtggttatgctcgaacagggtaaggaaccatgggcgctgcagggagagaggccacggcagagctgtccaggagagaaactctgggatcataaccaatgcaggaagattctgtcatacaagcaggtcagttcgcagccacagaaaatgtaccctggagagaaagcatacgaatgcgctaagttcgagaagatttttacgcagaagtcacagctaaaagttcaccttaaagtgctcgccggagaaaagctgtacgtttgtatagaatgtgggaaggccttcgtacagaagcccgagtttatcatccatcaaaagacccatatgagagagaagccttttaagtgcaacgaatgcggaaaatcatttttccaggttagctccctattcagacatcaacgtatacatacaggcgaaaaactatatgaatgttcgcagtgcggaaagggatttagttacaactccgacctgtccatacatgagaagattcatacaggtgagagacaccacgaatgtactgactgtgggaaagccttcacccaaaagagtaccctaaagatgcaccagaagattcacactggcgagcgctcatacatctgtatcgagtgtggccaggccttcattcaaaagacacatctgatagcccatcgacgtatccacactggagagaagccttatgagtgctccaattgtggtaagagcttcatatccaaaagtcagctgcaggtgcaccagcgagtgcatacccgggtaaagccctacatctgtacggaatacgggaaggttttcagcaataactccaacttggtgacacacaagaaggtacagtcgcgagagaagtcttctatctgcaccgaatgcggaaaggccttcacctataggagcgacctgattactcatcatcggatccataccggggagaaaccatatgagtgttcagactgcggcaagtctttcacgaaaaagagccagctccaggttcatcaaaggatccacactggagagaaaccttacgtttgcgccgagtgcggcaaggcatttacggatcgcagtaacttgaacaagcatcagacaactcacactggagacaagccgtacaagtgtggtatctgcggcaaggggtttgtgcaaaagtctgtgttttccgtacatcagtcgtctcatgcatag

SEQ ID NO: 25559 - DNA, 2310 bp, Artificial Sequence
  Description of Artificial Sequence: Synthetic coding sequence
atgcccgctaactggacctcgccacagaaatcctcagcgctggcacctgaagaccacggcagttcctacgaaggcagtgtcagtttcagagacgtggcgattgatttctcccgggaggagtggagacatctggacccaagccagagaaacttgtacagggatgtgatgctggagacctatagccacctcctgagtgtgggctaccaggtccccgaggccgaagtggtgatgcttgaacaaggcaaggaaccctgggccctgcagggcgagcgccctagacagtcatgccccggagaaaagctgtgggatcacaaccaatgtaggaagatcctgtcttataaacaggtatccagtcagccacaaaaaatgtaccctggcgagaaggcatatgaatgtgcaaagtttgaaaagatcttcacccagaaatcacagctgaaggttcatctcaaagttcttgcaggagagaaactgtacgtttgtatcgagtgcggaaaggctttcgtacaaaagccggagttcattattcaccagaaaacgcatatgcgagagaagccgttcaagtgtaacgagtgcggaaagagcttttttcaagtctcgagtctgtttaggcaccagcgcatccacactggcgaaaaattgtacgagtgttcccagtgcgggaagggattttcatacaattctgatttgagtattcatgagaaaatacatacaggagagcgccatcatgagtgtacagattgcggcaaagctttcacacagaagtctacacttaaaatgcaccaaaagattcacacaggcgagcgatcctatatttgcatcgagtgcggtcaggcgttcattcaaaaaactcacctgatcgcccaccggaggatccatactggtgaaaaaccttatgagtgttctaattgtggcaaatctttcatttccaagtcgcaactccaggttcatcagagggtgcatacgagagtgaagccatatatttgcacggaatacggtaaggttttttccaataactccaatttggtgacgcataagaaagtgcagagtcgtgagaagtctagcatctgcaccgagtgcgggaaagccttcacctaccggtccgaacttattatccatcagcgtattcatacaggcgaaaagccctacgaatgttccgattgtggcaaagccttcacgcagaaatccgctctgaccgtgcatcaacgaatccacaccggggagaagtcttacatctgcatgaagtgtggtctcgcatttatccagaaggcccatctgattgcccatcagattatccacactggggagaaaccccacaagtgtggacattgcggcaagctgttcacttccaaaagccagctgcatgtgcacaaacgaattcatacaggggaaaagccctacatgtgcaacaagtgcgggaaagccttcacgaatcgctctaacctgatcactcatcaaaaaactcatacgggggaaaaatcctatatctgctccaaatgcggaaaggcattcacccagaggagtgacctcattacacatcagcgtatccacactggcgagaagccatacgagtgtaatacctgtgggaaagccttcacacaaaagagccacctgaatattcaccagaagattcatactggcgagcggcagtacgagtgccacgaatgcggaaaagccttcaaccagaaaagtatactgatcgttcatcagaagatccacacgggcgagaagccatatgtttgcactgagtgcggcagagcgtttattaggaagagcaactttattacacatcaaaggattcatactggcgagaagccttacgagtgctctgactgcggcaaatcctttaccagcaagagccagctcctggtacaccagcctgtccacaccggagaaaagccctatgtgtgtgctgaatgcggcaaggcattcagtggaaggagtaacctcagtaagcatcaaaaaacacatacgggagaaaaaccctatatatgcagtgagtgtggaaagacattcaggcaaaagagtgagttgattacccaccacaggatacacactggggagaaaccctacgagtgtagcgattgcggcaaatctttcaccaagaagagccaacttcaggtgcatcaacgcatccacactggagaaaagccttatgtttgtgccgagtgcggcaaggcgttcaccgatagatctaacctgaataagcatcagaccacacacaccggtgacaagccctacaaatgcggaatttgtggtaagggttttgtccaaaaatctgtgtttagcgtgcaccagtcaagccacgcgtag

SEQ ID NO: 25560 - DNA, 2145 bp, Artificial Sequence
  Description of Artificial Sequence: Synthetic coding sequence
atgctggaaacctactctcatctgctgtcagtcgggtaccaggttccagaagctgaggtggtaatgctggagcaagggaaggagccttgggccctacagggtgaacgcccacggcagtcatgcccaggcgagaaactgtgggatcataatcaatgccgaaagattctttcatacaaacaggtttcaagccaaccacagaaaatgtaccccggtgaaaaggcttatgaatgtgcaaagttcgagaagatttttactcagaaaagccagctcaaagtgcacttgaaagtcctcgccggtgagaagctgtatgtttgtatcgagtgtggcaaagcttttgttcagaaaccggagttcattatacatcagaaaactcacatgcgtgaaaaaccattcaaatgcaatgagtgtggcaagagcttcttccaggtctctagcctgtttagacatcagagaattcacacgggagagaagctctatgaatgttctcagtgcggaaagggcttttcctacaacagtgacctctcgattcacgagaagatccacaccggggaaaggcaccacgaatgcactgactgtggaaaggcattcacccaaaagagtacgttaaagatgcatcagaagatacacacaggcgaacgaagttacatttgcatcgaatgcggacaggcctttatccagaagacacacttgatcgcacacagacgaatccatacgggcgaaaagccatatgaatgttccaattgtggaaagtcttttatctcaaagagtcagctccaggtgcatcagagggtgcacactcgggttaagccttacatttgcactgaatatgggaaagtattctctaataatagtaatctggttactcacaagaaggtgcaatctcgggaaaagagcagtatctgtacagagtgtggcaaagccttcacctaccggagcgagcttattatccaccaaagaatccacacgggcgagaagccttacgagtgctctgactgcggtaaagcattcactcagaagtctgcgttaaccgtgcaccaacgaatccacacaggcgaaaagagctacatatgcatgaaatgcgggctggccttcatccaaaaagcgcacctcattgcccatcaaatcatccatacaggcgagaagccccacaagtgtggccattgtgggaagttgttcacaagcaaatcgcagctgcatgtccacaaaaggattcacaccggggaaaaaccttatatgtgtaacaagtgcggcaaagcttttacaaacagatccaacttgataacgcaccaaaaaacccacacgggagaaaagtcctacatttgctccaagtgtggtaaagccttcactcagcgctctgatttaatcactcaccaaagaatccatacaggggagaagccttacgaatgcaatacctgtggtaaggccttcacccaaaaatctcatctgaacatacatcagaagatccacacgggagaaagacagtacgagtgccatgaatgtgggaaggcctttaaccaaaagagcattctcattgtgcaccagaagatccataccggcgaaaagccatatgtctgtacagaatgcggcagagccttcatacgcaagtctaatttcatcactcatcagagaatccacaccggagaaaaaccctatgaatgttccgactgcggaaagagtttcacatccaagtctcagctgctggtgcaccaacctgtacatactggagaaaagccatatgtgtgcgctgaatgtggaaaagcattctctggaagaagcaacttgtctaagcaccagaagactcacaccggcgagaagccgtatatctgctcggagtgcggtaaaacttttcgccaaaagtccgaactgattacccatcatcgtatccataccggagagaagccttacgaatgtagtgattgcggcaagtcttttacaaaaaaatcacagctacaggtccatcagagaattcacaccggtgaaaaaccgtatgtgtgcgcagagtgtgggaaggcgtttacagaccgcagcaaccttaataaacatcaaacaacacataccggagataagccttacaaatgcggcatctgtgggaaaggattcgtccagaaatctgtctttagcgtgcaccaaagctcacacgcctag

SEQ ID NO: 25561 - DNA, 1074 bp, Artificial Sequence
  Description of Artificial Sequence: Synthetic coding sequence
atgaagtgcggactggctttcataagaaaagcccacctgatcacgcaccagatcatccatacaggagagaagccatataagtgtgggcactgcggaaaactgtttacatctaaatcgcagctgcatgtgcataaaaggattcataccggcgagaagccgtacgtctgcaacaagtgtggtaaagccttcacaaaccgttccaatctcattactcaccagaagacacatacaggcgagaaatcttacatctgttccaagtgtggtaaggctttcacacagcgttcagatctgattacgcaccagcggattcatactggcgaaaagccgtacgaatgtaacacatgtgggaaggcttttactcagaaatccaatcttaatattcaccagaagatacatacaggagaacgccagtacgagtgccacgagtgtggcaaggccttcaaccagaagtccatcttgatcgtccaccaaaaaatccacaccggcgagaagccctatgtctgcaccgagtgcggtagggctttcatccgtaagtccaacttcataacacatcagcgcattcataccggcgagaagccttatgagtgttccgattgtggtaaaagctttacatccaagagtcagctcttggtgcaccagcctgtccacacgggagagaaaccatatgtttgtgcagagtgtggcaaggccttttccgggaggtctaacctgagtaagcatcagaaaacccatacgggggagaagccgtacatctgttcagagtgtggtaaaacttttagacagaagtcagagctaataacccaccaccgaatccacactggtgaaaaaccttacgagtgctcggattgcggtaaaagtttcacgaaaaagtctcagctccaggtacaccagaggattcacactggtgaaaaaccttatgtctgcgcagagtgcgggaaagcctttagtaaccggagtaacctgaataagcaccaaactacccacactggggataaaccctacaaatgtggcatatgcggcaaaggattcgtacagaaatccgtgttctctgttcatcagagtagtcacgcctag

SEQ ID NO: 25562 - DNA, 2145 bp, Artificial Sequence
  Description of Artificial Sequence: Synthetic coding sequence
atgcttgagacatatagtcatctgctgtctgttgggtatcaagtccctaaaccagaagtcgtgatgctcgagcaaggaaaggagccgtgggcacttcagggggaaaggcctaggcacagttgtcccggtgagaaactgtgggatcataatcaacacagaaagattattggatacaagcccgcttcaagccaggaccagaaaatctatagcggagaaaagtcttacgaatgcgcggaattcggcaagagtttcacctggaagtctcaatttaaagttcatctcaaagtcccgacgggcgagaagctgtacgtgtgcatcgaatgcggacgagcttttgtacagaagcctgaattcatcacacaccaaaaaactcatatgcgcgagaaaccgtataagtgcaatgaatgcggcaagagttttttccaggtgtcctctcttttccgacaccaccggattcacacaggagagaagttgtacgaatgctccgagtgtggcaaggggttcccatataatagcgacctgtccattcacgaaaaaatccacacaggtgaacggcatcacgaatgtacggactgcggaaaagcctttactcagaaaagtacgctgaagatccaccagaaaatccatactggagaacggtcctatatatgcatcgagtgcggtcaggccttcatccagaagactcagttgatcgcgcatcgccgaattcactctggcgagaagccatatgaatgcaacaattgtgggaagagcttcatttccaaatcccagctccaagtgcaccagcgcgtgcacaccagggtgaaaccatacatttgtacagagtacggcaaggtgttttctaataattctaatctgattacacacgaaaagatacagtctcgggagaaatccagcatctgcaccgaatgcggcaaagcattcacctaccgcagcgagctgattatccaccagcgtattcatactggggaaaagccctacgaatgttctgactgtggccgagcattcacacaaaagtccgccttgacagtccatcagaggatccacacaggggaaaagtcttacatttgtatgaagtgcggtctggccttcatcaggaaggcacatctgatcacgcaccagatcatccataccggggagaagccttataagtgcgggcactgtgggaagcttttcactagtaagagtcagttacacgtgcacaaaagaatccacaccggcgagaagccttacgtttgcaataagtgcggtaaagcatttaccaatcggtccaaccttataacccatcagaagacacacactggcgagaaatcctacatctgttcgaagtgcggtaaggcattcacccagcggtccgacttgattacccaccaaaggatccataccggagagaagccctatgaatgcaatacctgcgggaaggcattcacccagaaatccaacctaaatattcaccagaagatccacaccggagaacgacagtatgagtgtcacgagtgcgggaaggcgttcaatcagaaaagtattctaatcgtccatcagaagattcacactggagagaaaccctacgtgtgtaccgaatgtggcagggctttcattcggaagtcaaacttcattacacatcagagaatccatactggggaaaaaccttacgaatgttcagactgcgggaaatcattcacatccaaatcacagctgctcgtgcatcagcccgtgcacacaggagaaaaaccttatgtgtgtgccgaatgtggtaaggctttttccggcaggtccaacttaagcaagcatcagaagacccataccggcgagaagccatacatttgtagcgaatgcggaaagaccttcaggcaaaagagcgaactcattactcatcatcgcattcacaccggggaaaagccctatgagtgcagtgattgtggaaaaagttttacaaaaaaaagccagttgcaggttcatcagcgcattcataccggcgaaaagccatatgtttgcgcagaatgcgggaaggcattcagtaatcgatccaatctgaacaaacaccagaccacacacacaggggataagccatataagtgcggtatttgcggtaaaggtttcgtccagaaatctgtgtttagcgtgcatcaaagttctcacgcctag

SEQ ID NO: 25563 - DNA, 2310 bp, Artificial Sequence
  Description of Artificial Sequence: Synthetic coding sequence
atgcctgcttcctggacctcaccccagaagagctccgcattagccccagaggatcacggaagctcatacgaaggctcagtcagctttcgggacgtggccatcgacttcagccgggaggagtggcgccacctagacctgtcacaacgtaacctgtaccgagacgtgatgttggagacatactcccatttgctgtctgttggttaccaagtccctaaaccagaggtagtgatgctcgagcagggtaaagagccatgggcacttcagggcgagcgaccacgccactcatgtcctggcgaaaagctgtgggaccataatcaacacaggaagatcatcggatacaaacctgcatcctctcaggaccagaaaatctactctggagagaaatcttacgagtgtgcagaatttggcaaatcctttacttggaaatcacagtttaaagtgcacctaaaagtccctaccggagaaaaactatatgtgtgcatcgaatgtggtcgcgctttcgttcaaaagcccgaatttatcacccaccaaaagactcacatgcgcgagaagccatataagtgcaacgagtgtggcaagtctttcttccaggtgagctctcttttccggcatcatcgtatacacaccggagagaagctttatgagtgttcggaatgcggcaagggcttcccctacaactccgatctcagcattcacgagaaaatccacaccggggagaggcaccacgagtgcaccgactgcggtaaagctttcacccagaagagcacactgaaaatccaccaaaagatccacactggagagcggtcttatatatgcatagagtgcggccaagcatttatccaaaagacacagctgattgcgcatcggaggatccattccggtgaaaagccttatgaatgtaataactgcggtaagtcctttatcagcaagagccagctgcaggttcaccagcgcgtgcatacccgcgtgaagccttatatctgtaccgagtacggcaaagtattctccaacaacagcaacctcatcacccatgagaagatccagtcccgcgaaaaatcctcgatctgtaccgagtgtggaaaggcgttcacttatcgctctgaactgattatacaccagaggattcatacaggggagaaaccttacgaatgtagcgattgcgggagggctttcacgcagaaatcagctctgactgttcaccaacgaatccacaccggagagaaaagctacatctgcatgaaatgcggtctcgcctttatcagaaaggctcacctgattactcatcaaatcattcatacaggcgagaaaccctacaaatgcgggcattgtggcaagctattcactagtaagagccagttgcatgttcacaaaagaatccacaccggggaaaagccttacgtctgcaacaaatgcggcaaagccttcactaatagatcaaacctcatcacacaccagaaaacgcacacgggggaaaaatcctacatttgttctaagtgcgggaaagctttcacgcagcgtagcgacctgataacccatcagcggatacatactggcgagaaaccctacgaatgcaatacgtgcggaaaagcatttacacagaagagcaatctgaacattcaccagaagatccatactggagagcggcagtacgaatgtcatgaatgcgggaaggccttcaatcagaaaagcattctaatcgtgcatcagaagatacacaccggtgagaagccctacgtgtgtaccgagtgtggacgcgctttcatacgaaagtccaacttcattacacaccagaggatccacaccggggagaaaccatacgaatgttcagattgtgggaaatcattcacctccaaaagccagttgctagtacatcagccagtgcacaccggggagaagccttacgtttgtgcggaatgtggaaaggctttctccggaagaagtaatttgagcaagcatcagaaaacccacacgggcgagaaaccgtatatctgctccgaatgcggtaaaactttccgccagaagagcgagctgattacacatcaccgcattcacacgggcgagaagccttacgagtgcagtgactgtgggaaatcttttacaaaaaaatctcaactgcaggttcaccagagaattcatactggggagaaaccctatgtttgcgcagagtgcggtaaggccttctctaaccggagcaacctaaacaaacaccagactacgcatacgggggacaagccatacaagtgtggcatttgtgggaaaggttttgtgcagaagagtgtattttctgtgcatcaaagttcccacgcctag

SEQ ID NO: 25564 - DNA, 195 bp, Artificial Sequence
  Description of Artificial Sequence: Synthetic coding sequence
atggctgctgcagcagccctgagggctcccgctcagtcttcggtcacttttgaggacgtggccgtcaatttctctttagaggagtggagcctccttaacgaggcccagggatgtctttaccatgatgtaatgctggaaaccttgacactgatttcgtctctcgggtgctggttgcaggttgaagacggggcttag

SEQ ID NO: 25565 - DNA, 1080 bp, Artificial Sequence
  Description of Artificial Sequence: Synthetic coding sequence
atgttagagacactaaccctgatcagttctctagggtgctggcatggtggcgaggatgaagctgccccatctaaacagtctacatgcattcacatatataaggaccagggtgggcatagcggagaaaggccgtatgaatgcggcgagtatcgcaagttgtttaaaaataaatcctgtctgaccgaaccgagaagagatcacaagcatcgcaacgtgcgtactggagaaagaccctacgagtgtagtaagtatgggaagttattccatcagaaaccaacactgcatattcatgagcgcttccacaccggccaaaagacgtatgagtgttccgaatgcggtaagagcttccaccagagtagttctctgctccagaggcagacactccatacacgggaacgtccatatgaatgcatcgagtgcggaaaggcctttgccgagaaatcttcactcataaaccacagaaaagtgcactcaggagcaaagcgctatgagtgtaacgaatgtgggaagagctttgcttatacaagcagccttatcaagcaccggcgaattcacactggagaacggccatacgaatgcagtgagtgtggtagatctttcgcagaaaattccagtctgattaagcatctgcgggtgcatacgggagagcgtccttatgagtgcgtagagtgtgggaagtctttcaggcgctcaagctccctccttcagcaccagagggtccatacaagggagaggccatatgaatgctccgagtgtgggaaaagcttttctctacggtctaacctgattcaccaccagcgtgtgcatactggagagagacatgaatgcggccaatgcgggaagtcttttagccgcaagtctagtctgatcatccatcttcgtgttcataccggggaaaggccctacgagtgttctgattgtggtaaatcctttgcagagaactcaagcttaatcaagcacttgcgcgtccatactggcgagagaccctacgagtgtattgattgtgggaagtcgtttcggcatagttccagctttaggaggcaccagcgcgtacacacgggcatgcgcccttacaagtag

SEQ ID NO: 25566 - DNA, 633 bp, Artificial Sequence
  Description of Artificial Sequence: Synthetic coding sequence
atggccgcagccgcagcgctgagggcacccgctcaggttgtgggcatggagggcaaaatgagacagcacctgctatctcgtgcacgcgtgtatatttatacaaagacccgggaagtgatcgtggagaaaggcctgatgagcgtgggtaatataggcaattatttaagaacctcacctgcaagcctgaatcccgaggaaataaccaatacgggcatgttcgctctggagaagggcctgatgtccgcagccaacatggggaattatttcacaaaaagtctgcatagcattttcatgcgcgacttcattcttgggaaacggccaatgtcggctgtctcagttgaaaatcattttaccaaggcattgcattcatgtagtgtaaggcattttacgttggagaaagggctgatgagtgtgctgaatgtgggaaagccactactgaagtctcctgtgtcactgacaactgggaaatttactctggagcaatctgtcatgaatgccatgaatgtgggctccccactgctcatacatctcgtcagccttaacactgggggatttacgttggaaaggggtttaatgagcgccgttaacgttggagatcctttgctcaagacacctgttctccttaacacatag

SEQ ID NO: 25567 - DNA, 1209 bp, Artificial Sequence
  Description of Artificial Sequence: Synthetic coding sequence
atggcagctgccgctgccctgcgcgctccagcgcagtcttccgtgacatttgaagatgtcgccgtgaatttttcactcgaggagtggtctctcctcaacgaggcccagcggtgcctatatagggatgtgatgctcgagacactgaccttgatcagcagccttggttgctggcatggaggggaggacgaagccgcaccctctaagcagtctacttgcatccatatctacaaggaccagggcggacactcaggcgaaagaccttacgagtgtggagaatacaggaaactgttcaagaataaaagttgcttaacagaaccaagaagggaccacaaacatcggaacgttcggactggcgaacggccttacgagtgctccaagtatggcaagctctttcatcagaagccaaccctgcatatacatgaacgcttccacacgggtcaaaaaacatacgagtgttcggaatgcggtaaatcattccaccagtcttcaagtctgctgcagagacagaccctacatactagggaacgcccatacgagtgtattgaatgcggaaaagctttcgcggagaaatcttccttgatcaaccaccgtaaagtccacagcggtgcaaaacgatacgagtgtaacgagtgcgggaagagtttcgcctatacctcatcccttatcaaacatcgcagaattcacactggggaacgtccttatgagtgttccgaatgtggacgcagctttgcggagaacagttccctcattaagcacctgcgagtgcatactggcgagagaccttatgagtgcgtagagtgtggtaaaagttttcggagaagcagtagcctactgcaacaccaaagggtacacacccgagagcgcccatatgaatgcagtgagtgcggaaaatctttcagtctccggagcaacctgatccatcaccagcgcgtgcatacaggcgagagacacgaatgtgggcagtgcgggaaatcttttagtagaaagtcaagcctgattatccacctgcgggtccacacaggagagaggccatacgagtgcagtgactgtggcaaatcgttcgcagagaatagctctctcatcaaacacttgagagtccacacaggggagagaccgtacgaatgcattgattgtggtaagagctttcggcactcatcctcttttcggaggcaccagagggtgcataccggtatgcgcccatataagtag

SEQ ID NO: 25568 - DNA, 300 bp, Artificial Sequence
  Description of Artificial Sequence: Synthetic coding sequence
atggccgctgcagccgctcttagggctcctgcgcagagtagtgtcacatttgaggacgtcgcagttaatttttcgctggaagaatggtcgctgttaaacgaagctcagggatgtctttaccatgatgtgatgctcgagacgctcacactgatcagctcattgaaaggctgtaccaggcagcagttttgcaatcgctctacgctgaataaagaagatcgcgtcatctataacctcagacggagccccagttgtaggtttcccctccccggtacgggtcctcatatcctctatgtctcttag

SEQ ID NO: 25569 - DNA, 1209 bp, Artificial Sequence
  Description of Artificial Sequence: Synthetic coding sequence
atggcagcggctgccgctcttagagcccctgctcagagttctgtgacgtttgaagacgtggccgtgaatttcagtcttgaagagtggtccttgctgaacgaggcccagaggtgcctgtaccgggatgtaatgctggaaaccctcacactaatctcttcactgggttgctggcacgggggagaagacgaggccgcaccatccaaacagtctacatgtatccacatctataaggaccagggtggacatagtggcgagcgcccttacgagtgtggagagtatagaaaattgttcaagaacaaatcttgccttactgaacctcgaagagaccacaaacatcggaacgttcgtaccggagaaagaccatatgaatgcagcaagtacggaaagctgtttcatcagaaacctaccctgcacattcatgagcggtttcacaccgggcagaaaacttacgagtgtagcgagtgtggcaagagtttccaccagagctcaagtctgttacaaaggcagacattacatactcgagaacggccatacgagtgtatagaatgtggaaaagcatttgcggagaaatctagcctgattaaccatcggaaggtgcattcaggcgctaagagatatgaatgcaacgaatgtggcaagtcctttgcgtacacctcgagcttaataaaacataggcgaatacatacaggagagcgtccctatgaatgctccgagtgcgggagatcattcgccgaaaactcctccttaatcaagcatctgcgcgtgcacaccggagagaggccctacgaatgcgtggaatgtggaaaatcatttcggagatcctcgagtctcctgcaacaccagcgcgtacacactagggagcgtccatatgagtgctcggagtgcggcaagtcctttagtcttcgctcaaatttgattcatcaccaaagggtgcacaccggagagcggcatgagtgcggtcagtgtggtaagtcatttagcagaaagtcctctctgatcatccatctcagagtccacacaggtgaaaggccgtacgaatgcagtgattgcgggaaatctttcgccgagaattcctctctgataaaacacctgagagtacacacaggtgagcgcccatatgaatgcattgactgcgggaaatcttttagacattcttctagttttcggaggcaccagagagttcataccggaatgaggccttacaagtag

SEQ ID NO: 25570 - DNA, 498 bp, Artificial Sequence
  Description of Artificial Sequence: Synthetic coding sequence
atggcagctgcagcacctcgacggccaacacagggcactgtgacgtttgaggacgttgccgtcaagttcactcaagaagaatggaatctgttaagtgaagcccagaggtgtttataccgcgatgtcacgttagaaaaccttgccctcatgagttctttaggatgctggtgcggcgtggaagacgaagctgccccttctaagcagagcatttatatccagcgagaaactcaagtgcggactcctgtgacaggagtatcacctaagaaggcccacccatgcgaaatgtgcggacctatcctcggggacatcctacatgtcgcagatcatcaaggcacacaccacaaacagaagttacacaggtgcgaggcttggggaaataaattgtacgatagcggtaacttccaccagcaccaaaatgagcacattggggagaagccctacagaggcagtgttgaggaagctctgttcgtgaagaggtctggccactgcgatctctag

SEQ ID NO: 25571 - DNA, 1728 bp, Artificial Sequence
  Description of Artificial Sequence: Synthetic coding sequence
atggccgctgccgttcctcggcgacccacacaacaggggactgtgactttcgaggatgtcgccgtaaatttttcccaggaagagtggtgcttattatccgaggcccaacggtgcctctaccgcgatgtaatgctcgaaaacctggcgcttatttccagtctgggctgctggtgcgggtctaaggatgaagaggccccatgtaaacagagaatcagtgttcagcgcgagagccagtctcgtactccccgtgcaggtgtgagccccaagaaggctcatccgtgcgaaatgtgtggcctaatcctggaggacgtgtttcattttgcggaccaccaagagacccaccacaagcaaaagttgaaccgaagcggagcctgtggaaagaatttggacgatactgcctacctgcaccagcaccagaagcagcacatcggggagaagttctaccggaagtccgtgcgcgaagcatcgttcgtgaagaaacgcaaactgcgcgtgtctcaggagccatttgtctttcgagagttcgggaaagacgtcctcccaagctctggactctgtcaggaggaagccgctgtcgaaaagacagatagcgagactatgcacggaccgccttttcaggagggaaaaaccaactacagctgtgggaaacgcaccaaggcgtttagcacaaagcactctgtcattccccaccagaagctcttcacccgagacggctgctatgtgtgcagcgattgtggaaagtcctttagtcgctacgtcagtttttcgaatcaccaaagggatcacactgcgaaaggcccatatgactgtggagagtgtgggaagtcctattctagaaaatcttctctaatccaacatcagagggtgcacacaggacaaaccgcatatccttgtgaggaatgtggcaaaagcttttcacagaagggaagtttgatcagccaccagctcgttcatacgggcgaggggccttacgaatgtcgggaatgcgggaagtcatttggccaaaagggcaacctcattcagcaccagcaaggacacaccggcgaacgggcataccattgtggcgagtgcgggaagagcttccggcagaagttttgttttattaaccaccagcgcgtgcacactggcgagcggccttacaagtgcggtgaatgtgggaaatcttttggccagaagggcaacttggtccaccatcagcgcggacacactggtgagaggccatatgaatgtaaagagtgtggaaagtcttttcgctaccgcagtcatctgacggaacaccagagactccacacaggggagcgaccgtataactgccgggaatgcggcaagctattcaaccgtaagtaccatctgctcgtgcacgagcgtgtgcataccggcgagaggccttatgcatgcgaagtatgcgggaaactgtttggtaataaacattccgttactattcatcagaggattcatactggagagaggccctacgagtgttcagaatgcggaaagtcatttctgagctcctctgctctgcacgtacacaaacgcgtacactcagggcagaagccttacaagtgcagcgagtgtggcaaaagctttagcgaatgttctagtttgatcaaacatcggcgaatccatactggcgaacggccttacgaatgcacgaagtgcggtaaaactttccaacggtcctctacactgttgcatcatcagagttcccacaggcgcaaagccctgtag

SEQ ID NO: 25572 - DNA, 1599 bp, Artificial Sequence
  Description of Artificial Sequence: Synthetic coding sequence
atgttagaaaatctggctctgatctcttcactggggtgctggtgcgggtccaaagacgaagaagcaccgtgtaagcaacggatatctgttcagcgagagagtcagtccaggactcccagggctggggttagtcccaagaaagcccacccatgcgaaatgtgcggcttaatcctggaggatgtgttccacttcgcagaccaccaagaaacacatcacaaacagaagctgaacagatccggagcttgcgggaaaaacctcgacgacaccgcatatctacaccagcaccagaagcaacatataggcgagaaattttatagaaaatccgttagagaggcgtctttcgtcaagaagcggaagttgagagtaagccaggagccatttgttttccgggaatttggcaaagatgtgctgccatcatctgggctatgccaggaagaagcggcagttgagaaaaccgacagtgaaaccatgcacggcccaccgttccaggagggcaagactaactactcctgcggcaagcgcactaaggccttcagcactaaacatagcgtaatcccacaccagaaactcttcactcgtgacggctgttatgtgtgtagcgactgtggtaaatctttttctaggtatgtgtctttcagtaaccaccagagggatcatactgccaaaggtccatatgattgtggggagtgtggtaaaagctattcccgaaaatcttcgttaatccagcatcagcgagtgcacaccggacaaaccgcatacccctgtgaggagtgcggcaagtccttcagccagaagggcagtttgatttcccaccaattagtgcacaccggtgagggaccctacgaatgccgcgagtgcggcaagtcatttggacagaagggaaacctgattcagcatcaacaagggcatacaggagaacgtgcgtaccactgtggggaatgtgggaaatcattccgccagaaattctgttttatcaaccatcagcgcgtacatacaggagaaaggccgtacaagtgtggtgagtgtggcaagagtttcggccagaagggaaacctcgtgcatcatcagcgcggacataccggtgagcgcccatacgaatgcaaagagtgtggaaagagctttagataccgctcccacttgacggagcatcaaaggcttcacaccggagagcgaccatacaactgtcgggagtgcggcaaactcttcaacagaaagtaccaccttctggtacatgaacgagtccacactggcgagcggccttacgcctgtgaggtgtgcggcaaactgtttggcaacaagcattccgtgacaatacaccagagaatacacaccggagagagaccctacgaatgtagcgagtgcggcaaatcttttttgtctagctccgccctgcacgtccacaagcgcgttcacagcggacagaagccttataagtgcagcgaatgcggcaaaagtttctcagagtgctcgtctctgattaaacatcgccgaatccacactggggagcgcccatatgaatgtacgaaatgcggcaaaacatttcagagaagtagcacattgctgcatcatcagtcttctcatcggcgtaaggcgttatag

SEQ ID NO: 25573 - DNA, 1209 bp, Artificial Sequence
  Description of Artificial Sequence: Synthetic coding sequence
atggctgtggtcgctactctaagactgagtgcacaggggactgtgaccttcgaggacgtagccgtcaaatttacacaggaggaatggaacctgttaagtgaagcccaacggtgcttataccgggatgtcacattggaaaatctggctttaatgtcatctcttgggtgctggtgtggtgtagaggacgaggccgcaccaagcaagcagtctatttatatacaacgggagacgcaggtgcggacccccgtcactggcgtttcacccaagaaggcccacccctgtgagatgtgtggtcccatcctcggcgatattctgcatgtagctgatcatcagggaacacaccataagcagaagctgcacaggtgcgaagcatggggaaacaagctttacgacagcggaaactttcaccaacaccagaacgaacatatcggcgagaaaccctacaggggaagtgtcgaggaagcactgtttgtcaagaggtgcaaactgcatgtgagtggagagtcaagcgtattctcagagtcgggaaaggattttctgcctcggtctggacttctgcaacaggaagcgagccataccggggaaaagagtaatagtaagaccgagtgtgtgtcccccttccaatgtggaggcgcacattacagtcatggtgactcaatgaagcatttttccacaaagcatattttatcacaacatcagcgcctgctccctagagaagaatgttacgtgtgttgcgagtgcggtaagtcattcagtaagtacgtatcatttagtaaccaccagcgggtccattcaggcaaacgaccttacgagtgcggagaatgcgagaagagtttctctcagaagtctagcctcatccagcatcaacaattccacacagggggaaaaccatatggatgtgaagagtgtggtaaatatttttcactggaaggatatcttaggcgtcatcaaaaggttcacgctggaaaggggccttatgaatgtggtgaatgtggaaagtccttttcctctaatgtgaaccttaaatcccaccagcgcattcataccggagaaaggccatacaagtgcggagaatgtgagaagagttttagtagaaagccgtctctgtcttatcaccagagatttgggcgaccgagatgggtcgatcacaaagacagaaaggaattcaaaactagcctcggaaatattgtcaagagttgtcttttctag

SEQ ID NO: 25574 - DNA, 1860 bp, Artificial Sequence
  Description of Artificial Sequence: Synthetic coding sequence
atggcagccgctgtccccagaaggccaacacagcagggtaccgttaccttcgaggacgtcgccgtgaatttcagccaggaggagtggtgcctgctcagcgaagcacaacgctgtctgtacagagacgtgatgcttgaaaatttggccctgatcagcagcctgggatgctggtgtggtagcaaagatgaggaagcgccatgtaagcagagaatcagcgtccagcgggaatcccagtcccgcacacccagggccggagtgtcccctaaaaaagcacatccctgcgaaatgtgtggcctgatcttggaggatgtcttccattttgccgaccaccaggaaactcatcacaaacagaaactcaatcgaagcggggcatgtggcaagaatttagatgacactgcttatttgcaccagcatcagaaacagcacattggggaaaaattctatcgcaaatctgtgagagaagcatcatttgttaaaaagaggaaactacgggtgtcccaggagcccttcgtttttcgggagttcggcaaggacgtcctgccctcgagcggactgtgtcaggaggaagccgcagtggaaaagaccgacagcgagacaatgcatggccctcccttccaggagggtaaaactaattattcgtgcgggaagagaaccaaggcattctctactaagcatagcgtgataccgcaccagaagctgtttactagagacggctgctacgtgtgctctgattgcgggaagtctttttccaggtacgtaagcttctcaaatcatcagagagaccacacagctaagggcccatacgactgcggagagtgcgggaaatcatactcccgaaaatcaagtctgatccagcaccagagagtgcacactggacagaccgcttacccctgtgaggagtgcggcaagtccttttcccagaagggcagcttgatcagtcatcaacttgtgcacacgggggaaggcccttacgagtgtcgcgaatgtggaaagagttttggacaaaaggggaatttaattcagcatcagcaagggcacactggggagcgggcttatcattgcggtgaatgcgggaaatcttttcggcagaaattctgtttcataaatcatcagagggtgcacactggcgagcggccatacaagtgtggagagtgtgggaaatcctttggacagaagggaaatctggtgcatcaccaacggggacacacaggagaacgcccttacgagtgcaaggagtgcggaaagtcatttcgctaccgcagtcatctgactgagcaccagagactccacactggagagcggccttacaactgtcgggagtgcggtaagctcttcaaccgcaagtatcatctgttggtccatgaaagagtgcacaccggagagaggccgtacgcctgtgaggtgtgtggtaagttgtttggcaacaaacatagcgtcactatccaccaacggatccacacaggggaacgcccatatgaatgctccgaatgtggcaaaagtttcctgtctagcagtgctctgcacgtgcacaagagagtccatagtggacagaagccttacaagtgttcagagtgtggcaagtcattttccgagtgctcctccttgattaagcatcgtcggattcacaccggagagaggccatatgaatgtacaaagtgtggcaagacatttcagagatcttctaccctgttacaccaccgcgtgcacacgggtgagcggccatacgaatgtagtgagtatggcaagtcatttgcagaagccagtagactcgtgaagcaccggagggtgcataccggcgagcggccatatgagtgttgtcagtgcgggaagcaccagaacgtgtgttgcccgagaagctag

SEQ ID NO: 25575 - DNA, 1269 bp, Artificial Sequence
  Description of Artificial Sequence: Synthetic coding sequence
atgatagacttccagatgctcaatcagctgtgcagaactatcatcaatcccagtgttatcccctgtctgaaatactgcggggatcagatcgggcctgtcacttttgaggatgttgctgtactctttaccgaagcagagtggaagagactgagcctcgagcagaggaacctctacaaagaggtgatgctggaaaacttgcgcaacctggtcagcctggaaagtaagccagaagtgcacacttgtccatcctgtccactggcttttggttctcaacagttcctgagccaggatgaactccacaatcacccaatcccaggcttccatgctgggaaccaactgcatcccggaaacccatgtcccgaggatcagccccaatcccagcatcctagtgataaaaatcacaggggcgcagaagctgaggaccaacgggtcgagggcggagtaaggcctctcttttggtccaccaatgagcggggtgccttggttgggttctcaagcttatttcaacggccacccatcagtagctggggtggcaacaggatcctcgagatacaactgtcacccgcacagaatgcttcgagtgaagaagtggatagaatcagcaagcgcgctgagacccccggattcggcgctgtgaccttcggagagtgtgccttggctttcaatcagaagtccaacctgttcaggcagaaggctgtgactgctgagaagtcttccgataaacgccagagccaagtatgccgagagtgcggaagagggttcagccgcaagagtcaactgattattcatcagcgtactcacacaggcgaaaagccatacgtgtgtggagagtgcgggagggggttcatcgtcgaaagcgtccttcgaaatcatcttagcacccactcgggggagaagccctacgtctgttctcattgcggcaggggcttctcttgcaagccttacctaatcaggcaccagcggacccacacccgggaaaagagctttatgtgcaccgtgtgtgggagaggatttcgggaaaagtctgagctgatcaagcaccagcagcggtgccaggtgacagtgcccttggaagagtggtcattacacctgaccacatctttttgcaactgcgtgctgcctctcgcatccatgaccttaagctgcttcatctttttttacattagcagcctgtgctgtttcctgtcctatcccacgtttagattttactcagaattctcactccaaccatataatttaagggatacattcacacggtccccctcttag

SEQ ID NO: 25576 - DNA, 1095 bp, Artificial Sequence
  Description of Artificial Sequence: Synthetic coding sequence
atgtgggcacccagggaacagctgctgggctggaccgccgaagctctcccagcaaaggatagtgcatggccatgggaagagaagccaagatatctcgggcctgtaacattcgaggatgtcgcagttctattcacagaggctgaatggaaacggctgagtctggaacagagaaacttgtacaaggaggttatgctggagaacctccgcaatctggtgagcctggcggaatcgaaacccgaagttcacacatgccccagttgtcccttggctttcggttcccaacagttcctcagccaggatgaactccacaaccatcccatcccaggattccatgcaggcaatcaactacacccagggaacccatgtccagaagaccagccacagagtcagcaccctagtgataaaaaccataggggcgcagaagccgaggatcagagagtggaaggcggtgtcagacctctgttttggtctaccaatgaaaggggggctctggtgggcttctccagcctgttccagaggcccccaatctcttcctggggcggtaatcgcattttggagatccaacttagccccgctcagaacgcctcgtccgaggaggttgaccgcatcagcaaacgggcagagacaccgggattcggggctgttacatttggggagtgcgcgcttgccttcaatcagaaaagcaatctctttagacagaaggcggttaccgcggagaagtcctctgataagagacaaagccaagtttgccgtgaatgcggtcgaggcttctcacgcaaatcacagctcattatacatcagcggactcatacaggggaaaaaccatacgtgtgcggcgagtgcggcaggggctttattgtggaaagcgtcctacgtaaccacctgtccacgcacagtggtgagaagccttatgtctgtagtcactgcggccgaggcttcagttgtaaaccatacctgattagacatcagcgcacccacactcgcgaaaaaagcttcatgtgtaccgtatgtggacggggattccgtgagaaatctgaactgattaaacaccagcgcatacacacaggcgacaagccatatgtctgtcgagattag

SEQ ID NO: 25577 - DNA, 534 bp, Artificial Sequence
  Description of Artificial Sequence: Synthetic coding sequence
atgtgggcccctcgggaacagcttctgggatggacagccgaggccctgccagccaaggactcagcctggccatgggaggagaaaccacgttatctagggcctgttacgttcgaggacgtggcagtattatttacagaggcagaatggaaaagattatctttggaacaacggaatctatataaggaagtgatgctcgagaatctgcgcaacctggtgtcactggagtccaaacctgaagtgcacacatgtccatcctgcccgttagcattcgggtcacagcagttcctctcacaggatgaactgcacaaccaccccatacctgggttccatgctggaaatcagctgcacccaggaaatccatgtcctgaagatcaacctcagtctcagcatccctcagacaagaatcaccgaggcgctgaggcagaggaccaaagagtggagggtggggtccgaccgcttttctggattcttgaactagggagtccccgatcaggtctgctgccactggatcttaatcttgatctgtggctgtag

SEQ ID NO: 25578 - DNA, 1095 bp, Artificial Sequence
  Description of Artificial Sequence: Synthetic coding sequence
atgtgggcccctcgtgagcagctactgggatggacagcggaggccttaccagccaaagatagcgcctggccctgggaggagaagcctcgctatctgggaccagtgacctttgaagatgtggccgtactattcaccgaagcggaatggaagcggttatccctcgagcagagaaacctctacaaggaagtcatgctcgaaaacctcagaaaccttgtttcgctggctgaatccaagcccgaagttcatacttgcccctcatgcccactggccttcggatcccagcagtttttgtcccaggatgagctgcacaaccatcccattcccggattccatgccggtaaccagcttcaccctggtaatccttgccctgaagaccagccacaaagccagcacccatcagacaaaaaccatcgcggtgcagaggcagaagaccaaagagtcgagggaggagtccgtcccctgttttggtccaccaacgagaggggtgccctggtcggcttttcgtccctctttcagagacctccaatcagcagctgggggggaaacagaatcctggaaatccagctcagccccgctcagaatgcttcaagcgaggaggtcgatagaatttcaaaaagggccgagactcctggctttggcgcagtgacatttggtgaatgcgccctggcctttaaccaaaagagcaatctgtttaggcagaaagctgtcaccgctgaaaagtcaagcgataagaggcagtcccaggtttgccgggaatgtggacgagggttctcgcgtaagtcacagctgatcatccaccagcggacacacactggtgaaaagccctacgtgtgcggcgaatgcggtcggggattcatagtggagtccgtattgagaaatcacttaagcacccattccggtgaaaaaccatatgtgtgtagtcattgtggcaggggtttctcatgtaaaccgtatctgatcaggcaccagaggacccacacccgagaaaagtctttcatgtgcaccgtgtgcggcaggggttttagggagaaatctgaactcatcaagcatcagcgcattcacaccggcgataagccatatgtctgtcgggattag

SEQ ID NO: 25579 - DNA, 471 bp, Artificial Sequence
  Description of Artificial Sequence: Synthetic coding sequence
atggggcgatcgcgcagaactggggcacatcgcgcacatagccttgccagacagatgaaggccaaacggcgacggccagacctcgacgaaatccacagggaactgcggcctcagggctcagccaggcctcagcctgacccaaacgccgaatttgaccccgacctgcccggtggcggactgcatcgctgcttggcctgcgcacgttattttatcgacagcaccaacctaaagacccactttagatcaaaggatcacaaaaagcgttacgaaggagttaggaggggcttgatggatggctgcagcgctgacagggcgcttacgtggtctgcgcctaattcctgcttctctttctcccaagcagaggccgcagagagacgagcactgcagtccggacgcggtggcgagggaagcggctacggaatcctctgcgcgccacaggcagcaggatctgctcacgggtctgtgcattag

SEQ ID NO: 25580 - DNA, 405 bp, Artificial Sequence
  Description of Artificial Sequence: Synthetic coding sequence
atgggccgaagccgaagaaccggcgctcatagggcccatagcctggccaggcagatgaaagctaaaaggaggaggccggacttggatgaaattcatcgagagttaagaccccaggggtctgctcgcccacagcccgatcccaatgccgaatttgatcccgatttgcccggaggcggacttcatcgctgcttagcctgcgctcggtactttatcgattcgaccaacttgaagacgcacttccgcagcaaagatcataaaaaacgactgaaacagctctctgtggagccctactcacaggaggaggctgagcgggctgctggtatggggtcttatgtacccccacgacgcctagccgtcccgaccgaggtgagcaccgaggtgcctgaaatggacacttcaacatag

SEQ ID NO: 25581 - DNA, 996 bp, Artificial Sequence
  Description of Artificial Sequence: Synthetic coding sequence
atgaatgtgaagaatgtgggaaagcttaaccagtccagtgacctattgaggcaccatcgaattcacagtggggagaagccttatgtctgtaacaaatgtggagagtctttccggagctcgtccgacctcattaagcaccaccgcgtgcatactggggagaagccccacgagtgttcagagtgtggcaaagtttttagccagcggtcacacctcgtgacccaccagaaaatccatactggagaaaaaccatatcagtgtacagagtgtgagaaggcttttcgcaggcggagtctgctgatacaaagacgaagaattcattccggagagaagccatatgagtgcaaagaatgcggaaagctctttatgtggcatacggctttcttaaaacatcagcgcctccatgccggagaaaaactggaagagagggaaaagaccttctctaaagacgaggagctccgcggagagcagaagattcatcaggaggagaaagcgtattggtgtaaccaatgtggcagagcttttcaaggctccagtgatcttatcggccatcaagtgacccatacaggcgaaaagccatatgagtgtaaagagtgcggcaaaactttcaatcagtcatctgatctcctcagacatcacagaatccatagcggggaaaagccatacgtctgcaataaatgtggtaagtcctttcggggtagctctgacttgatccggcaccaccgtgtgcataccggagaaaaaccctatgagtgtccagagtgttggaaagccttttcacagaactctcacttggtgtcccatcaacgaatacacacccgagagaaaccgttcgaatgttccaactgcggaaaggcgtttagcgggtggactgccttcctcaagcatcagaaattgcatatcggaaaagaatttgaagattgtaagagcctacaaacaggccctatcctaatcggaagccggaatctgatgaacgctgtcaaactgggaaaagtgtag

SEQ ID NO: 25582 - DNA, 918 bp, Artificial Sequence
  Description of Artificial Sequence: Synthetic coding sequence
atgaatgtgaagaatgttggtaagaaccagtcctctgacctgttacggcatcatcgtattcattcaggcgaaaagccttgtgtttgcagcaagtgtggtaagagcttccgagggagctcagacctgatccggcaccaccgggtgcacaccggggagaaaccatatgaatgctcggagtgtggaaaggcgttcagccagcggtcacatttggtcacccatcagaaaatccacactggagagaaaccatatcagtgcaccgagtgtggaaaggcctttcggcgtcgttcacttctcatccagcaccggaggatccactcaggcgagaagccgtacgaatgcaaagaatgtggtaaactgtttatttggcggacagccttccttaagcatcagtccctgcatacgggggagaagcttgaatgcgagaaaacgtttagccaggatgaggagctgcgcggagaacaaaagattcatcaggaagccaaggcatactggtgcaatcaatgcggaagggcttttcagggctcatccgatctcatcaggcaccaagtgacccacacaagagagaagccttatgagtgtaaagagtgtggtaaaacttttaaccagtcatccgacctcctgaggcatcatcgaattcactccggagagaaaccctacgtgtgtaacaaatgtggaaagagctttcggggtagcagtgatttaataaagcaccatcggatccacaccggagagaagccctatgagtgcagtgagtgcgggaaggcctttagtcagcgcagtcacttggccacccatcagaagatccacaccggcgaaaagccctatcagtgtatggaatgcggcaagctgtttatgtggcacaccgcattcctgaaacaccagcggttgcacgcaggggaaaaattggaggaatgttag

SEQ ID NO: 25583 - DNA, 2424 bp, Artificial Sequence
  Description of Artificial Sequence: Synthetic coding sequence
atgaaggaatggaagagtaagatggaaatcagcgaggagaagaaaagcgctcgagcagcctcagagaagctccagaggcaaatcacccaggaatgtgaacttgtcgagacttccaactctgaagaccgcttgctgaaacattgggtctctccacttaaggacgctatgcgacacctgccgagtcaggaaagtggaatacgtgaaatgcacattatcccacagaaagccatcgtaggcgaaattggccacgggtgcaatgaaggagagaaaattctgtctgctggtgaatcttctcatcgatacgaagtctctggtcaaaactttaaacaaaagtctgggttgaccgagcaccaaaagatccacaatataaacaaaacttacgaatgcaaggagtgtgagaaaaccttcaatcggagcagcaacctgatcatccaccaacgaatccacacaggcaataagccctatgtgtgcaacgagtgcgggaaggattctaatcagtccagcaacctcataattcatcagcgaatacacaccggaaagaagccctacatctgtcacgagtgtggaaaggactttaaccaaagttctaatctggtgagacataaacagatccatagcggcggaaatccctacgagtgtaaggaatgcggcaaagctttcaagggctcaagtaacctggtgttgcatcagaggatccatagccgaggcaagccttacctttgcaacaaatgcggcaaggcctttagccagagtactgacctgattatccatcatcggatacacaccggtgaaaagccgtacgagtgttatgattgcgggcagatgttcagccagagttcccatttggtcccacatcagcgcatccacacaggtgagaaaccattgaagtgcaatgagtgcgaaaaggcttttcgacagcactcgcatctgaccgagcaccagcggctgcattccggcgagaaaccttacgagtgccacagatgtggaaaaactttctccgggaggacggcattcctgaaacatcagcggcttcatgctggcgagaaaattgaggaatgtgagaaaacattcagtaaggacgaggaacttcgggaggaacagaggatccaccaggaggagaaagcatactggtgcaaccagtgcggacgcaatttccagggaacttcagacctgattcgccaccaggtgacacacaccggtgagaaaccctacgagtgcaaggagtgcgggaaaacttttaatcaaagctctgatttgctgcgtcatcatagaatccactcaggagaaaagccatgcgtttgctcaaaatgcggaaagtcatttagaggcagctcggacctcatccgacatcaccgagtgcatacaggagagaagccatatgagtgtagcgagtgtggcaaggctttcagtcaacggtcccacctggttactcatcagaagattcataccggagaaaagccctatcagtgcaccgaatgtggaaaagcttttagaaggagatctcttctcatccagcacaggaggatccacagcggggagaaaccgtatgaatgcaaagaatgcgggaaacttttcatttggaggaccgcatttctcaaacaccagtctctgcataccggcgagaaactagagtgtgagaagacctttagccaggatgaagaactacgaggcgagcagaaaatccaccaggaggccaaggcatattggtgcaaccaatgcggacgtgcgtttcagggatctagcgacctgattcgccatcaggttacacacacacgggagaagccttacgaatgcaaagaatgtggaaagactttcaaccagtcctcggatctgctaagacaccaccgaatccatagtggcgagaaaccttacgtgtgcaacaaatgcggcaagagcttcaggggatcttctgacctaataaagcaccatcgcatccacacgggtgagaagccctatgaatgttccgagtgcggaaaggctttcagtcagaggtcccacctcgccacacaccagaagatacataccggagaaaaaccataccagtgctctgagtgtggaaacgcttttaggaggagatcgctgctgatacagcacaggaggcttcacagtggggagaaaccatacgagtgcaaagaatgtggcaagctgttcatgtggcatacagcttttttaaagcatcagcggctccacgcgggtgagaaattggaggagtgcgagaagaccttctctaaagatgaggaacttcgtaaggaacagaggactcaccaagaaaaaaaagtctattggtgcaaccagtgttcccgcacatttcagggttcttccgaccttatcagacaccaagtgacccacacccgggaaaagccctacgagtgtaaggagtgtggaaaaactcaaagcgagctgcgcccatccgagacatcctag

SEQ ID NO: 25584 - DNA, 1515 bp, Artificial Sequence
  Description of Artificial Sequence: Synthetic coding sequence
atgccgagcccggacagtatgaccttcgaggatattatagtagacttcacccaggaggaatgggcgctactggacaccagccagcggaagctgttccaggacgtgatgctagaaaatatatcgcaccttgtgtctataggcaagcagttatgtaaatcggtcgtcctaagccaactcgagcaggttgagaagttaagtactcagagaatctctctcctgcagggtcgagaagtgggtatcaaacatcaggagattccctttattcagcatatttaccaaaagggcacgtcaaccattagcacaatgcgcagtcacactcaggaggaccctttcctctgcaacgatcttggagaagatttcacacaacacattgccttaacccagaatgtgattacctacatgaggacgaaacatttcgtctctaagaaattcggcaagatattcagcgactggttaagcttcaaccagcataaagagatccacaccaaatgcaaatcctatggttcccatctctttgactacgctttcatccagaactctgccctgagacctcactcggtgacccacaccagggaaattacccttgaatgccgagtttgcggaaagacgttcagcaagaattctaacctcaggcggcacgagatgatccacactggcgaaaaaccccatggctgccacctctgtggaaaggcttttacccactgctcggacctgagaaagcacgagcgtacgcacaccggtgagaaaccttatggctgtcacctgtgcggcaaagccttcagcaaaagctcaaatctgcgaagacatgaaatgatccacacgagagaaaaggcccaaatctgtcatctgtgtggcaaagccttcactcactgtagtgacctgagaaagcatgagaggacacacctcggggacaaaccctacggttgcctcctctgcggtaaagccttttccaagtgcagctatttgagacagcacgagcgtacccacaatggggaaaagccttatgagtgtcatctgtgcggtaaggcattttcccattgcagccatcttcgccagcacgagcggtctcataatggggagaagccgcatggctgtcacctgtgtggcaaggccttcaccgagagctccgtcctgaagagacatgaaagaattcatacaggcgaaaagccctatgagtgtcacgtttgcgggaaggcattcacggagtctagcgacctgcgcaggcatgaaagaacacatacgggtgagaagccttatgagtgtcatctatgtggcaaggccttcaaccatagtagcgtcctaaggcgccacgaaaggacgcacacaggggaaaagccctacgaatgcaacatctgcggaaaggcatttaaccgaagctataacttccgactgcaccgcagagtgcatactggcgagaaaccatacgtctgtccactgtgtggcaaggccttctccaagtttttcaatcttagacagcacgagcgcactcacacaaaaaaggcgatgaacatgtag

SEQ ID NO: 25585 - DNA, 1305 bp, Artificial Sequence
  Description of Artificial Sequence: Synthetic coding sequence
atgcccagtccagactcaatgacctttgaagacatcatcgtagacttcacccaggaagaatgggcacttttggacacaagccagcggaagttattccaggacgtgatgctagaaaatatctctcaccttgtctccatcggcgaggacttcactcagcacatagctctgacgcagaacgtgattacatacatgcgtacaaagcacttcgttagcaaaaagttcggtaagatttttagtgattggctctcgttcaaccaacataaggagattcatactaaatgtaaatcttacggcagtcaccttttcgactatgctttcatccagaactctgctctccggcctcacagcgtgacccacacgcgggagatcacactcgaatgcagagtctgcggcaagaccttctcaaagaactcgaatcttaggcgacacgagatgatccacacaggtgaaaaaccccacggctgtcatctatgcggcaaggccttcacacattgtagtgacttgaggaaacacgaaaggacacacaccggggagaagccctatggatgccatctatgcggaaaagccttctcaaagtcctcaaacctgagaagacacgaaatgatccacacccgggaaaaagcacaaatctgccatctctgtggtaaggctttcacgcattgcagcgacctcaggaaacacgagcgtacacacttgggagataagccatacggctgtcttctttgtggcaaagccttctccaaatgcagttacttaaggcagcacgagcggacacataacggcgaaaaaccatacgagtgtcacctatgcggaaaggcgtttagtcactgctcacatctgcgccagcatgagagaagccataatggtgagaagcctcacggctgccacctgtgcggcaaggcgtttactgagtcttcagttttgaagcgacatgagaggattcacactggcgaaaagccttatgagtgtcatgtgtgcggaaaggccttcaccgaaagttctgacctcaggcggcacgaaaggactcacacaggcgaaaagccatacgaatgtcatctttgcggcaaggctttcaatcactcatcagtgctccgtaggcacgaaagaacacacacaggggagaagccgtacgaatgcaacatatgtggaaaggctttcaaccggtcttataacttccggctgcaccgcagggtgcacactggggagaaaccttacgtatgcccactttgcggcaaagcattttcaaaattcttcaacctgcgccagcatgaacggactcacactaaaaaggctatgaacatgtag

SEQ ID NO: 25586 - DNA, 1515 bp, Artificial Sequence
  Description of Artificial Sequence: Synthetic coding sequence
atgccgagccctgacagtatgacatttgaggatatcatagttgattttacccaggaggaatgggcgctcctggatacaagtcagcggaaactattccaggacgtgatgctcgagaatatttcccacttggtgtcaattggaaagcagctttgtaagagcgtcgtgctgtctcagctcgagcaagtggagaagctgtcaactcagcgaatttctctcctgcagggaagagaggtcggtataaagcaccaagagatcccgtttatccaacacatctatcagaagggcaccagcaccatttctactatgcggagccacacacaggaagaccctttcctgtgcaacgacctgggagaggacttcacacagcacatcgctttgacccagaacgtcatcacctacatgagaactaagcatttcgtttccaagaaattcgggaagattttctccgactggctttcctttaaccagcacaaagaaatccacacaaagtgcaagtcctacggcagccatctatttgattacgctttcattcagaactccgcccttaggccacactcggtcactcatacaagagagatcaccctggaatgcagggtgtgcggaaaaacatttagcaagaactccaatctgaggagacatgagatgattcacaccggtgagaaaccccatggctgccacctctgcgggaaggcgttcactcattgtagcgatctccggaaacatgagcgtactcataccggcgagaaaccgtacggctgccatctatgcggaaaagctttttccaaaagtagcaaccttcggagacatgagatgatacatactcgggaaaaagctcaaatttgccatctctgcgggaaggcctttacgcactgttctgacttgaggaagcatgaaagaacccatttaggcgacaagccgtacggctgtctgttatgcggaaaagcctttagtaagtgctcctatctgcgccagcacgaacgcacccacaacggggagaagccctatgagtgccacctctgtggaaaggctttttcccattgctcacatctcagacaacatgaacgatctcacaacggggagaagcctcatggttgccacctgtgcgggaaggcttttacagagtcttccgttttgaaaagacacgaacgcattcatactggtgagaagccatatgagtgccatgtgtgcggaaaagcgtttacagaatcctcagacttgaggagacacgagagaacccatacgggcgaaaagccgtacgagtgccacctgtgcggtaaggctttcaaccactctagcgtgctacgtcgtcatgaacggacccataccggagagaaaccctatgagtgcaacatttgtggaaaagcctttaaccgctcatataacttccgtctgcaccggagggtgcatacaggagaaaaaccctacgtttgccctttgtgcggcaaggcattttcaaagttttttaacctgcgacagcacgaacgcacacacaccaagaaggccatgaacatgtag

SEQ ID NO: 25587 - DNA, 1275 bp, Artificial Sequence
  Description of Artificial Sequence: Synthetic coding sequence
atggcatccatgcctccgacacctgaggcacaaggaccaatcctgttcgaagacctggcagtttacttctcacaagaggagtgcgttacattacatcctgcacagaggtcactgagcaaggatggtacaaaagagtccctagaggacgctgcacttatgggggaggaaggaaaaccagaaattaaccagcagctatccctcgagagcatggagctggatgagctggccctcgagaagtatcccatcgcagctccactggtaccatatcctgagaaaagctcggaggacggcgtgggaaatcccgaggccaaaattttgagcggcacccctacgtacaaaagaagagtgattagcttgctagttacgattgagaaccacaccccactcgtggaactttccgaatacctaggcacaaacaccctttccgaaattctggactctccctgggagggtgccaaaaacgtgtacaaatgcccagagtgtgatcaaaatttttcagaccattcttacttggtgctccatcaaaaaatccatagtggggagaaaaagcataagtgcggcgactgcggaaagatttttaatcacagagctaacctgcggactcatcgtagaatccacacaggagagaagccctacaagtgcgctaaatgctccgccagcttccggcaacactcacacctctctagacacatgaattcccacgtgaaagaaaagccttatacctgtagtatctgtggccgtggttttatgtggctgccaggcttggcccaacaccagaagtcccactcagcagaaaatacctacgaaagtactaactgcgacaaacacttcaatgagaaacctaatcttgccctgcctgaagagaccttcgtgagcggacctcagtatcaacacaccaagtgtatgaaatccttccgacagagtctttatccggctctgtccgaaaagagccacgacgaagatagcgaacgctgtagcgacgacggtgacaatttcttctcattttctaaattcaaacccctgcagtgcccagactgtgatatgaccttcccctgcttcagcgagctgatctcccatcagaatatccatacagaagaacggcctcataagtgcaagacttgcgaagagagcttcgcattagattcagaactggcatgtcaccagaaatcacatatgctggctgaaccatttaagtgcacggtttgtggtaagaccttcaagtcgaacctccatctcattacccacaaacgaacacacatcaagaacactacatag

SEQ ID NO: 25588 - DNA, 1767 bp, Artificial Sequence
  Description of Artificial Sequence: Synthetic coding sequence
atggccgctcccgcactggcactggttagctttgaagacgtggtggtgaccttcaccggtgaggaatggggacacctggatctcgctcagagaacactgtatcaagaggtcatgcttgagacctgcagactcttagtgagcctcggccatccggtgcccaagcctgagctgatctacctgctggaacacggacaggaattatggacggtgaaacgaggactcagccagtcaacgtgcgccggagagaaggccaagccaaagattacggagcctactgcttctcagctagctttctctgaggaatcttcgtttcaggagctcctggctcagcgctcttcacgggatagtcgcctcgggcaagccagggacgaggagaaattgatcaaaatccaggaaggaaatctgagacctggtaccaatccccacaaggaaatttgtcctgaaaagctgagctacaagcatgacgacctggagccagacgattctctcggtctccgagtgctgcaggagcgggttactccgcaggatgcattgcacgagtgtgattcccagggcccaggcaaggacccgatgactgacgctcgcaacaatccctatacttgtacagaatgcggaaaaggattttcgaaaaagtgggccctggtccggcatcaacagattcacgccggagtcaagccgtacgaatgcaacgagtgcggcaaagcgtgtaggtatatggcagacgtgatccggcatatgagacttcatactggtgaaaaaccgtacaaatgcatcgaatgcggcaaggccttcaagcgcaggttccatctgactgagcatcaaagaattcataccggggacaagccgtacgagtgtaaggagtgcggtaaagccttcacccatcggagctctttcatccagcacaacatgacacacacgcgcgaaaaaccctttctctgtaaggaatgtggaaaagccttctattacagtagtagcttcgctcagcatatgaggattcacacgggtaagaagctctacgagtgcggcgaatgcgggaaagcgtttacacataggtccacattcatccagcataacgtcacccataccggagagaagcctttcctttgcaaggaatgcgggaaaaccttttgtcttaactcaagttttactcagcacatgaggatccatactggagaaaagccttacgagtgtggggaatgcggcaaagccttcacccacagaagcacttttattaggcacaagcggacacacactggcgagaaaccttttgaatgtaaggagtgcggaaaagccttctgcgattcttcgtccctcatccaacacatgagaatccacacaggggaaaagccgtatgaatgctctgagtgtgggaaggcttttacacatcattccgtgttcataagacacaacagaacccattccggacagaagcccctcgagtgcaaagaatgtgcaaaggccttctattatagtagctcttttactagacacatgaggatacataccggtgaaaaaccttacgtgtgtcgcgagtgcggcaaagcttttacccagcccgcaaacttcgttagacataatcgcatccacacgggggagaagcctttcgaatgtaaggaatgtgaaaaagctttctgcgacaacttcgctctgactcaacacatgcgaactcataccggggagaagccatttgaatgtaacgagtgcggcaaaaccttttcccacagcagctccttcacacaccatagaaagattcatacacgggtctag

SEQ ID NO: 25589 - DNA, 270 bp, Artificial Sequence
  Description of Artificial Sequence: Synthetic coding sequence
gccctcgtgtctttcgaagatgtggtcgtaacttttactggcgaggagtggggacatctggatcttgcccaacgaacactgtatcaagaggtcatgttagagacatgtaggttgctcgtgtccctgggtcacccagttccgaaacctgagctgatttacctcctggagcacggccaagagctgtggacagtcaaacgaggcctgtctcagagcacatgcgccgcatctttttcactgttatggaagtcctatcatcctgggcatggctag

SEQ ID NO: 25590 - DNA, 927 bp, Artificial Sequence
  Description of Artificial Sequence: Synthetic coding sequence
tatacatgtaccgagtgcggcaaaggtttctcaaagaagtgggccctggtgcggcaccaacaaatccatgccggagtgaaaccctatgaatgcaatgagtgcggcaaggcatgtagatacatggccgacgtcattcggcatatgcgactccacactggcgagaagccatacaaatgcatcgaatgtggcaaagccttcaaacgcagattccacctgactgaacaccaacggatacacaccggagataaaccttacgaatgcaaagagtgcgggaaggccttcactcatcgatcctctttcgcacaacatatgagaatccataccggaaaaaaactgtacgaatgtggggaatgcgggaaggcattcacacatcgtagcactttcatccaacacaatgtaacgcataccggggaaaagccatttctgtgcaaagagtgcggcaaaactttctgcctgaattcatccttcacgcagcatatgagaatacacacaggcgagaaaccctatgaatgtggcgagtgcgggaaggctttcacgcacagatcaaccttcatacgtcataaaaggacccatactggcgagaaaccctttgagtgtaaagaatgcggaaaagctttttgtgacagtagctcgctgatccaacatatgaggatccacacgggggagaagccttacgagtgctcagagtgtggaaaggcttttactcatcactccgtgttcatccgccacaaccgcacgcacagtggacagaagccattagaatgtaaggagtgtgctaaggccttttactacagctcttcgttcactaggcatatgagaattcataccggcgagaagccttacgtgtgccgtgagtgcggcaaagctttcactcagccagcgaatttcgttaggcacaacagaatccataccggcgagaaaccatag

SEQ ID NO: 25591 - DNA, 1764 bp, Artificial Sequence
  Description of Artificial Sequence: Synthetic coding sequence
aaagctcccgcttcagccttggtgagctttgaggacgtggtggtgacgttcactggagaggagtggggtcatctggacctagcgcagaggaccctgtatcaggaggtgatgctggaaacatgccgactcttggtatcactcgggcatccggtgccaaagcctgagctcatttatctgttggaacatggccaggaactgtggaccgttaagcgtggccttagtcagagcacatgcgctggcgaaaaggcaaaacccaagattactgaacccactgcgagtcagttagcttttagcgaggagtcatcgttccaagagctcctggcgcagcgatctagccgggacagcagactggggcaggctcgagacgaagaaaagctgatcaaaatccaggaaggtaacctgcgcccagggacaaatccacacaaagaaatttgccccgagaaattgtcctataagcacgacgatcttgaacccgatgacagcctaggattacgcgtgctccaagaacgtgttacaccacaggacgccttacacgagtgcgacagccagggcccagggaaagatccaatgacagacgccagaaataatccatacacatgcactgaatgtggtaagggattctccaagaaatgggcgctcgtaaggcatcagcagattcacgccggtgtgaagccctacgagtgcaacgagtgtggtaaggcctgccgctatatggccgacgttatcagacacatgagattacatacaggggagaaaccctataaatgtatcgaatgcggcaaggccttcaaacggcgattccacctcacagagcatcagagaattcacacaggtgataaaccatacgaatgcaaggaatgcggcaaggcattcacacaccgaagctcctttattcagcacaatatgacacacacccgcgagaaaccattcctttgtaaggagtgtggaaaggcattctattacagctccagcttcgctcagcatatgcgaatccataccggaaaaaagctctatgaatgcggcgaatgtggcaaggccttcactcatcggtcgaccttcatccagcacaacgtgacccatacaggtgaaaagcctttcctctgcaaggagtgtggcaaaaccttctgcttgaattcctcttttacacagcacatgaggatacacacgggcgagaagccttatgagtgcggcgaatgcggtaaggcgtttacccacaggagcacattcattcggcacaaacgaacccataccggggagaaaccatttgaatgtaaggaatgtgggaaggcgttctgcgactcatcctcattgattcagcacatgcgcattcacacaggcgagaaaccatatgaatgcagtgagtgcggaaaggccttcacccatcacagcgtgttcattcgccacaacagaactcactccgggcagaaaccactcgagtgcaaggagtgcgcaaaggctttctattatagttcatccttcactagacacatgcgtattcatacaggagagaagccatacgtttgtcgtgagtgcggcaaggcgtttacccagcctgctaatttcgttcggcataatcgaattcatacaggcgagaagccattcgaatgcaaagagtgtgagaaagccttttgtgataattttgcccttacccagcatatgcggactcacacaggtgaaaaaccattcgagtgtaacgagtgtggtaagacgttctcccactcatcatcttttacacaccacaggaaaatacacactcgcgtgtag

SEQ ID NO: 25592 - DNA, 2169 bp, Artificial Sequence
  Description of Artificial Sequence: Synthetic coding sequence
atgatgaaggaggtcttgtcaactgggcaggggaatactgaagtgatccacacaggaacactccaacggtatcagagctaccatattggcgatttctgttttcaggagattgaaaaggagatccatgacatcgagttccagtgtcaggaagacgagcggaacggccacgaagcaccaatgacaaagatcaaaaagctcaccggaagtaccgatcaacacgatcaccgccacgctggaaacaagcctatcaaggaccagcttggaagctctttctattcgcatttaccagaactgcatattatccaaatcaaaggaaagatcggcaatcagttcgagaagagtacctcagacgctccatcagtaagcacctctcagaggatttcacccagaccccagatccatatcagcaacaattacgggaacaactcccccaattcaagcttgcttcctcagaaacaggaagtgtacatgcgcgagaagagctttcagtgcaacgaaagcgggaaagcttttaactgttcaagcttactgcggaagcaccagatcccccatttgggggataagcagtataagtgtgacgtgtgtggcaaattatttaaccacaaacagtaccttacatgccattgccgctgccacacaggtgaaaagccttataaatgcaatgaatgtggaaaatcattcagtcaagtgtcatcgctaacttgtcacaggaggctgcacacagcggtgaaaagccacaagtgtaatgaatgcggcaagatattcggacagaattctgctctggtgattcacaaggctatccacacgggcgagaaaccttataaatgtaatgaatgtgataaggccttcaatcagcaaagtaacttggcccgacacagaagaatacacacaggagagaagccctataaatgcgaggaatgtgataaggtgttcagccgtaaaagcaccctggaatcgcataaacgcatacacaccggggagaaaccatacaaatgcaaggtgtgcgatacagccttcacctggaacagccagttagccagacacaaaagaatccacactggcgagaagacttataaatgcaacgaatgcggaaaaactttcagtcataagtcaagcctggtgtgccaccaccggctgcatggtggagaaaagagttataaatgcaaagtctgtgataaggcattcgcttggaactctcacttagtgaggcatactagaatccattcagggggtaaaccatacaagtgtaatgaatgtggcaagacattcggacaaaattctgaccttctgatccataagagcattcataccggggaacagccgtataagtatgaagagtgcgaaaaagtgttctcatgtgggagcaccctggagacgcacaagatcattcatacgggtgaaaagccctacaaatgcaaggtatgtgacaaagcgtttgcctgccactcatacctggccaagcacaccagaatacactctggcgaaaaaccttacaagtgcaacgagtgctctaagacatttcgcttaagaagctacctcgcgtcccaccgaagagtacatagtggtgagaagccctataagtgcaacgaatgtagcaagaccttcagtcagaggtcctatttgcattgtcacagaaggctgcatagcggcgagaagccctacaagtgtaacgagtgtggtaagactttcagccacaaaccatcgctcgtccaccatcgcaggctccacaccggtgaaaagtcctataagtgtacagtctgtgacaaggcgttcgtacggaattcctacctggccagacatacccggatacacacggctgaaaagccatacaagtgtaacgaatgcgggaaggccttcaaccagcagtctcagctctctttgcaccatcgtatccacgccggtgaaaagctatacaaatgtgagacttgcgacaaagtatttagtagaaagagccatttgaaacggcaccgcagaatccacccagggaaaaaaccgtataagtgcaaggtgtgcgacaagacattcggctcagatagccacctcaaacagcacaccggactgcacaccggtgagaagccctacaagtgcaacgagtgtgggaaagcttttagtaaacaaagtacattgatacaccatcaggccgttcatggtgtggggaagttggactag

SEQ ID NO: 25593 - DNA, 1926 bp, Artificial Sequence
  Description of Artificial Sequence: Synthetic coding sequence
atgattcagtctcagatatcgttcgaagatgtagccgtcgacttcaccctggaggagtggcaactactgaatcccacccagaagaatttataccgggatgtgatgctggaaaactattcaaacctggtgtttcttgaggtgtggctggacaatcccaagatgtggctgcgtgataatcaggacaatctgaagagtatggagcgagggcacaaatacgatgtgttcggaaagatttttaatagctctattaacattgtccatgtcggcctgagatcacataaatgtgggacgggagagaaaagtctcaagtgcccgtttgacttactgattccaaaaaacaactgtgaacgaaaaaaaatcgatgagctcaacaaaaaattgctgttctgcatcaagcccggaaggacccacggaggaataaagtactgtgattgctccacttgcagaaagagctccaacgaggaaccatggctcacagcgaaccacatcacgcatacaggagtttacttgtgcatggaatgtggacggttttttaacaaaaagtcgcaactggtcattcatcaacgaacacacacaggagagaaaccatatcagtgtagtgaatgtgggaaggctttttcccaaaagagtctgcttaccgtgcatcagcgtacccattccggggaaaaacctcatggatgttctgagtgtcagaaggccttcagccgaaaatcgctgttaatattacatcaacggatccacaccggagagaagccgtacggctgcagtgagtgcgggaaagctttctctaggaaaagccagttaaagcgccatcaaatcacacacaccatcgaaaagccttattcttgcagtgagtgtggaaaggctttctcccagaagttgaaattaatcacccatcaacgggcacatactggggagaaaccttacccttgttcacactgtggaaaagccttcttttggaagagccagctgatcacacatcagcgaacacacaccggtaagaagccctacggttgtggagagtgtcagaaagccttttcacgcaatagcctgctgataaggcaccagcgcatccatacgggcgaaaagccttatgaatgtaatgaatgcggcgaggccttcattaggaaacctcaactcattaagcatcagatcacccataccggggaaaaaaattaccgatgctctgactgcgaagaggcctttttcaagaaaagtgagttgatccgtcaccaaaagattcatctaggggagaagccttacggctgcattcagtgcggtaagacattcttcggaaaatctcagctcttgacccatcaccgaacccacacaggggagaaaccgtacgagtgctctgaatgtggtaaagcgtttacccaaaaatcatcactcatctcccaccagcgaacacacactggcgagaaaccgtacgaatgttctgaatgtcgcaaaacattcagcgaaaagtctagcctcatacatcaccaaagaacacacacaggtgagaagccattcgaatgctccgaatgccgaaaagccttcgcgtggaagccacagcttctgagacaccaacggatccacacaggcgaaaagccttacgagtgctcagagtgtggaaaggctttcgttcaaaaagtccagctgatcaagcaccaacgcaaccacaccggggaaaagacttacggttgctctgattgtgctaaggctttcttcgaaaaggcacagctcatcattcaccaaaggattcacacaggggagcgcccatataagtgtggtgaatgcgggaagagcttcacccgaaagtctcaccttatgcgccaccaacggatccatactggcgacaagtattacgggtgtaacgaatgcgggaccacatttaaccggaaatcacagctcatgatccaccagcggaaccacatcatttag

SEQ ID NO: 25594 - DNA, 2019 bp, Artificial Sequence
  Description of Artificial Sequence: Synthetic coding sequence
atgattcagagccagattagtttcgaagacgttgctgtggacttcaccctcgaagagtggcagctcctgaaccctacccagaagaacctttatagggatgtcatgctcgagaattactccaacttggtgttcctgggctttcaaatattaaagcctgacgccatgttcaagctggaacagcaggatccttggattattggccaggaaatacttaaccagaacttctcggaggtgtggctggacaacccaaagatgtggttgcgtgataaccaggataatctaaaaagcatggagagggggcacaagtatgatgtcttcggaaaaatattcaacagtagcataaacattgtccatgtggggcttcggagccacaaatgtgggaccggcgagaagtcactaaagtgcccattcgatttattgattcctaagaataactgtgagagaaaaaaaatagatgaactgaacaaaaagctgctgttttgcatcaaaccagggaggacgcacggtggcatcaaatactgtgattgttctacatgcagaaagtcatcaaacgaggagccctggcttaccgctaaccacatcacacacactggggtatacttgtgtatggagtgtgggagattcttcaataagaaatctcagttggtgatccaccagcggacccacaccggcgagaaaccctaccaatgctccgaatgtggaaaagcattctctcagaaaagcctacttaccgttcaccaaagaacccactcaggagaaaaaccccacggttgttctgagtgccagaaggctttcagccggaaaagcctcctcattctgcaccaaaggattcacacgggcgaaaagccgtatggatgcagcgagtgtggaaaagctttctcgaggaagtcccagctgaagaggcatcagattacgcacacaatcgagaaaccctacagttgctcggagtgtggtaaagcctttagccagaaactcaagctgatcacacaccagagggcgcatacaggggagaaaccttatccatgttcccactgcgggaaagcttttttctggaaaagccagttaatcactcaccaaagaacacacaccggcaaaaagccatacggttgtggggagtgtcaaaaggcgttttcccgcaacagtctgttaattcgccaccagcgcatccacaccggagagaaaccttacgagtgtaatgaatgcggtgaggcttttatccgtaaaccccagcttatcaagcatcagatcactcacacaggggaaaagaattaccgatgttcagactgtgaagaagccttctttaagaagagcgagttgatccggcatcagaaaattcacttgggggaaaaaccctatggttgcattcagtgcggcaagacgtttttcggtaaaagccagctacttacccaccatcggactcatacgggcgagaagccttacgagtgcagtgagtgcggcaaagctttcactcagaagagcagcctgatatcgcaccagagaacccacaccggggagaagccttacgaatgcagcgaatgtaggaagactttctctgagaagtcatccctgatccaccaccagcgcacccacacgggagagaagccatttgaatgttccgagtgcagaaaggcatttgcgtggaaacctcagctgttgaggcaccagaggatccacactggcgaaaaaccgtacgaatgttccgagtgtggcaaagcatttgtgcagaaggtacaattgataaaacaccagcggaaccacacgggtgagaaaacttatggatgttcagattgtgcgaaagccttttttgagaaagctcagctgataatacaccaacgcatacacacaggagagcgcccatacaagtgcggagagtgcggtaaaagcttcacacggaaatctcacttgatgagacaccagaggatccacactggagataaatactacgggtgcaatgaatgcgggactaccttcaaccgcaagtctcagctgatgatccaccagagaaaccatattatctag

SEQ ID NO: 25595 - DNA, 2091 bp, Artificial Sequence
  Description of Artificial Sequence: Synthetic coding sequence
atgtcttacggatcgatcaccttcggggacgtggctatagatttctctcaccaggaatgggaatacctaagcctggtgcagaaaacattgtatcaggaagtgatgatggaaaactatgacaaccttgtatcattggctggacacagtgtgagcaagccagacctgatcactttactcgagcaaggtaaagaaccctggatgattgtccgagaggaaacacgaggggaatgtaccgacctggactctagatgcgaaatcatcagcgatggcaaaatgcagctctaccgtaagcattcttgcgttacgctgcaccaaagaatacataacggacagaagccatacgaatgcaagcaatgtcagaagagcttctctcacctgaccgaactgatggtccaccagaccattcacaccagtgaggaacccgatcaatgtgagaaattcaggaaggccttctctcacctgactgacctcaggaaacaccagaagattaacgctcgggaaaagccttatgaatgtgaagaatgcggaaaggttttttcctacccggcaaatcttgctcaacatgggaaggtccatgttgaaaaaccctacgaatgcaaggaatgcggcgaggcatttagaacgtcgagacagctaacagtgcaccacagattccactatggagaaaagccttatgagtgcaaggaatgcgggaaggctttctccgtgtacggtagactctccagacaccagagcatccatacaggcgagaaaccatttgagtgtaacaagtgtggcaagtcctttaggcttaaggctggcctgaaagtccatcagtccatccataccggcgagaaaccccatgaatgcaaggaatgcggaaaagcctttaggcagttctctcatttagtcggccataagagaatacacaccggggaaaagccctacgaatgcaaggagtgtggaaaggggttcacctgtagataccaattaaccatgcaccagcggatatactctggtgagaagcattatgagtgcaaggaaaacggagaggccttctccagtggccaccagttaacggcacctcacacattcgagtcagtggaaaagccctataaatgtgaggagtgcggcaaggccttcagtgtacatgggagattaactaggcaccagggaattcacagtggaaagaaaccttacgagtgcaataagtgcggcaaatcttttaggctgaactctagcttaaagatccatcagaacatccacaccggcgaaaaaccgtacaaatgtaaggagtgcggcaaggccttctcacagcgcgctcatttggcccatcacaatcgaatccataccggatataaaccctttgagtgtaaagagtgcgggaagtcttttcgatgcgcttcttatctggtgatccacgagcgcattcacacaggagagaagccctatgtttgccaagagtgcggcaaaggattctcctactcacacaaacttacaattcaccgtcgcgtgcacacaggggaaaagccctatgaatgtaaggagtgcggtaaggcattctcggtgtcaggacaacttacgcagcatctgagcattcacagtgggaaaaagcctttcgaatgcaacaaatgcggtaaatcattccgctttatctcggttctgaaggcacatcaaaatatccactcggccgaaaagccttacgaatgcaaagaatgcggcaaagcctttcggcatgcaacttccctgatctatcatgatcggacacacgcaggagaaaaatcctatgagtgtaaggaatgtggcgaaactttttcacacgcatctcacctgataatccacgagagaatccatactagtgacaaaccctacgaatgtaagagatgtggaaaagcttttcactgcgcaagctacttggttaggcatgagtcagtccacgcagatggcaacccatacatgtgtgaagagtgtggaaaggccttcaattcttctcacgaattgagcatccaccaccgggttcacactggcgagaagccttttaagtgtaacaagtgcaggcggagcttccgtctccgctcaatcctggaagtgcaccagaggatacatatatag

SEQ ID NO: 25596 - DNA, 2088 bp, Artificial Sequence
  Description of Artificial Sequence: Synthetic coding sequence
atgtcttacggcagcatcacctttggcgatgttgctatcgacttctcacatcaagaatgggaataccttagtctagtgcagaaaaccttgtatcaggaggtaatgatggagaattatgacaacttggtctctctgggccatagtgtctcgaagcccgacttaattacgctgttagagcaagggaaggaaccatggatgatcgtgcgcgaggaaactcgtggagagtgcactgatctggactcacgctgcgagatcatctctgacggcaagatgcagctctatcgcaaacatagctgcgtgactctccatcagagaatccacaacgggcagaagccctacgaatgcaaacagtgccagaaaagctttagtcaccttaccgaactaatggtgcatcaaaccatccatacaagcgaggagcccgaccagtgtgagaagtttcggaaagctttttctcatctgacagacctcagaaagcatcagaaaataaatgcgagggaaaaaccttacgaatgtgaggagtgtggcaaggtattctcatacccagctaacctagcccaacacggcaaggtgcacgtggaaaagccttatgagtgtaaggagtgcggagaggcctttagaacttccagacaactcaccgttcatcaccgttttcattacggggaaaagccatacgaatgcaaggagtgtggaaaggccttctcagtctatgggaggctcagtagacaccagtctattcacactggtgaaaagcctttcgaatgcaacaagtgtggcaagagtttccgtcttaaagctggtctgaaagtgcaccagagcatccataccggggaaaagcctcatgagtgcaaggaatgtggtaaagctttccgccagttcagccatcttgttggtcataaacggatccatacaggggaaaagccctacgagtgcaaagaatgtgggaagggtttcacatgccggtatcagctaactatgcatcaacggatctatagcggcgaaaagcactacgagtgtaaagaaaatggcgaggctttttcctccgggcaccagctgactgccccacacacgttcgaaagtgtggaaaagccatataagtgcgaggaatgtggcaaggctttttcagtgcacggcagactgactcgccaccagggtatccactcgggcaaaaagccatatgagtgcaacaagtgcggcaagagttttagactgaacagctcccttaaaatccaccagaatattcacaccggcgagaagccatataagtgcaaagagtgcgggaaggccttctctcagcgcgcacatcttgctcaccataaccggatacatacggggtataagcccttcgagtgcaaggagtgtggaaagtcatttcgctgcgccagctacctggtgattcacgagcgcatccataccggcgagaagccgtatgtgtgtcaggaatgtggcaagggcttctcatactctcataagttgaccatccacagaagggtacacacgggcgaaaaaccatacgagtgcaaggaatgtggaaaggcattcagtgttagcggacagctcacgcaacatctatcaatccactctggcaaaaagccgttcgagtgtaacaagtgcgggaagtcatttcgtttcatctcagtcctaaaggctcaccaaaacatacatagtgccgaaaaaccttacgaatgtaaagaatgcggtaaagctttccgccacgctacttcactgatataccacgatcgaacccacgcgggtgaaaaaagttacgagtgcaaagaatgcggagaaacattttctcacgcctctcacctgattatccacgaaaggatccacacctctgataagccttacgagtgcaaaagatgtggaaaggccttccactgcgcatcatatctagttaggcacgaaagcgtgcacgctgacggcaatccttacatgtgtgaggagtgcggcaaggcatttaactccagtcacgagctgagtatacaccaccgagttcacaccggagagaaacccttcaagtgcaataagtgccggcgttccttcagactcagaagcatcttggaggtgcaccaacgaatacatatctag

SEQ ID NO: 25597 - DNA, 4236 bp, Artificial Sequence
  Description of Artificial Sequence: Synthetic coding sequence
atgtctcttagtagtggggcaagcgggggaaaaggcgtggacgcaaatccggtggagacgtatgacagtggagatgaatgggatatcggcgtgggtaatctaataatcgacctggacgctgacttagagaaggaccagcagaaactggagatgtccggttcgaaggaggtcggcatccctgctccaaacgcagtagcaacactcccagacaacattaagttcgttaccccagtgcccggacctcagggtaaagagggcaaaagcaagagtaagcgttcaaagtcaggcaaagatacatcaaaacctacaccaggcacatccctctttactccatctgagggagccgcaagtaagaaggaggtgcaaggtaggtcaggcgacggcgctaacgcgggtggcctagtcgcagccatcgcacctaaggggtccgaaaaagccgctaaggcctctaggtccgtggccggatctaaaaaggaaaaagagaacagctctagtaaatccaaaaaggaacgtagtgaaggcgtgggaacctgtagtgagaaggatcctggagtgctgcaacccgtgccactcggaggtcggggaggtcagtacgacgggagcgccggtgtggacacgggggctgtggagccactagggagcattgcaattgaacctggagcggctcttaacccactgggaaccaagcccgaacccgaggagggtgagaatgaatgccggctgctcaaaaaggtcaaaagtgaaaagatggaaagccccgtatcgacgcccgcagtactccccattcacctgttagtgccagttgttaacaatgacatctccagcccttgcgaacagatcatggttcgtacaaggagcgtcggagtgaatacctgcgacgtggcgctcgctacagagcctgagtgtctggggccttgtgagccagggacatctgtgaacctagaaggcatcgtatggcaggaaacagaggacgggatgctcgtggtgaatgtcacatggcgcaacaagacctacgtgggcacccttcttgattgcaccagacacgactgggcccctcccagattctgtgactcacccacatccgatctcgaaatgaggaatgggcgaggcaggggaaaacgcatgcgcccaaacagcaacacaccagttaatgagaccgccactgccagcgactccaaaggaaccagcaatagtagtaagactcgcgctggcgctaactccaaggggaggagaggttctcagaattctagcgagcaccggccacctgcctcaagcacctccgaagatgtgaaagcgtctccatcctccgcaaataaaaggaagaacaagcctctctcagatatggaactcaactcttctagcgaagattctaaaggaagtaagagagtgaggaccaactccatgggaagcgctaccggaccactaccaggcacaaaagtcgagccaactgtgctggaccgcaattgtccttccccagtcctgattgattgtccccaccctaattgcaataagaaatacaagcacatcaatgggctgaaatatcaccaggcccacgctcacaccgatgacgactcgaaacccgaggccgacggagactccgaatacggcgaagaacctattcttcacgccgacctcgggtcatgcaatggggctagcgtcagtcagaaaggctcactaagccctgccagaagcgccactccaaaagtgaggctggtcgagccccacagcccctccccaagctcaaaattcagtactaagggcctgtgcaagaagaagttgagcggcgagggggatactgatttgggcgcactctctaacgacgggagcgatgacggcccttctgttatggacgagacttcaaacgacgcttttgactccctcgagagaaaatgcatggagaaagaaaagtgtaaaaaacctagcagcctgaaacctgaaaaaatccccagtaagtctctgaaatcagccagaccaattgcacccgctatcccccctcagcagatctatacattccagacagccactttcaccgccgcatccccaggctcatcaagcggccttacggcaacagtggctcaggcaatgccaaactctccccagctcaagccaattcagcctaagcccacagtgatgggcgaaccattcactgtgaatcctgctttgacacctgcgaaagacaaaaagaaaaaagataagaagaaaaaagaatctagcaaagagttggagtccccactgacccccggtaaggtctgtagggccgaagagggaaagtccccatttcgagaatcttcaggggacggcatgaaaatggagggcctattaaatggaagctcggaccctcaccagtcccgcctcgcttccattaaagccgaggccgataagatctactcgttcacagacaatgcccctagccccagtattggtggatcttcccgactggagaacacgactcctacacagcctctcacaccgctgcatgtagtgacacagaatggtgcagaggctagcagcgtcaagacgaactctcccgcttactctgacatttccgatgccggtgaggatggagaaggcaaggtggatagcgtgaaatccaaagatgctgaacagctggtcaaagaaggggctaaaaagacgttgttcccccctcagccgcagtccaaggacagcccctattaccaaggcttcgagagctattacagcccatcctacgcgcaaagctcccctggtgctctgaacccatcaagccaagctggagtggagagtcaagccctcaagaccaagagggacgaagagcctgaatctattgagggaaaggttaagaacgacatatgcgaggaaaaaaaacctgaactgtcaagctcaagtcaacagcccagtgtcatacagcaaagaccgaacatgtatatgcagagtctgtattataatcagtatgcttatgtgcctccctatggctattcagatcaaagctatcacacacatttgttgtccactaacaccgcttatcgtcagcagtacgaagaacagcagaagcgacagagtctcgagcagcagcagcgaggcgtggacaagaaagccgagatgggcctgaaggagcgggaggctgcccttaaagaggagtggaaacaaaagccttctattcctcccaccctgactaaggctccatccctgaccgacttagttaaatcagggcctgggaaggcaaaggagccgggtgcggaccccgctaaaagcgttatcatccccaagcttgacgacagctccaaactgccaggccaggcacctgaggggcttaaggttaaactgtccgacgcgagccacctgtctaaggaggcttctgaagccaagacaggggctgagtgtgggcgacaggcagagatggatcctatcttgtggtacagacaagaagctgagccgaggatgtggacgtatgtctaccccgcaaagtatagtgacatcaagtcggaagacgagagatggaaggaagagcgggataggaaactcaaagaagagcggagccgtagtaaagattcagttccaaaagaggacggaaaggagagcacatcatctgactgtaaactcccgacctccgaagaaagccgcttgggctccaaagagcctcgacccagcgtccatgtgcccgtttcatccccgctgactcagcaccaaagttacattccatatatgcacggatacagttattcccagtcctatgaccctaaccacccgtcgtaccgctcaatgcctgcagtcatgatgcagaattatcccggtagctacttgccttcatcctattcgttctccccctacggatctaaagtgagcgggggtgaggacgcagataaggcccgtgcaagtcctagcgtgacgtgcaagtcctcttccgagtctaaggccctggatattctgcagcagcatgcctctcactataaaagtaagagccccaccatttccgacaagacttctcaagaacgcgataggggtggctgcggtgtcgttggcggtggtggctcgtgtagcagtgttggcggtgcttccggtggagagcggagtgtagatcggcctagaactagtccatctcagcgactgatgagtacacaccaccaccatcaccatctaggttacagcctgttgcccgctcagtataatctcccttatgccgcaggtctgtcttctaccgccatcgttgcgagtcagcaaggctctacgccctcactgtatccaccacccagacgttag

SEQ ID NO: 25598 - DNA, 1260 bp, Artificial Sequence
  Description of Artificial Sequence: Synthetic coding sequence
atgctgtgtgacgaagaagctcagaagcgcaaggctaaagagagcgggatggctctgccacagggaagacttacattcatggatgtagcaatcgagttcagtcaggaggaatggaagtcccttgacccaggacagagagccctttaccgagatgttatgcttgaaaattatagaaatctggtgtttctggggaggtcctgcgtgctggggagcaatgccgaaaataagcctatcaaaaatcagctggggctcacactcgaggctcatctgagcgagcttcagctgtttcaggctggaaggaaaatctatcgaagcaaccaggttgagaagtttaccaaccaccgctcatccgtgagtccgctccagaaaatttcttcatccttcactactcatatctttaacaagtaccgaaatgatttgatcgacttcccgctgttaccacaggaagaaaaagcctatattcgtggaaaatcttatgaatatgagtgttccgaagacggggaagtcttccgggttcgagcttccctgacgaaccaccaggtcattcacaccgctgagaaaccctacaaatgcacagagtgtggtaaggtctttagtcgcaactcccacctggtggagcactggcggatccatacggggcagaagccttataagtgctccgagtgcgacaaagtctttaacaggaattccaacctggcacggcatcagaggatccacacgggtgaaaagccacacaaatgtaacgaatgtggcaaagcctttagggaatgctccggtctgacaacgcatttggttatccatacaggggagaagccatacaagtgcaacgagtgcggtaagaactttaggcacaagttttctttaaccaaccatcagcgatctcacaccgcagagaagccttataaatgcaatgaatgcggaaaggtctttagcctgctctcatatcttgctcgccatcaaattatccacagcaccgagaaaccatataagtgtaatgagtgtgggagggcctttcataaacgtccagggctcatggctcatctgcttattcacactggggaaaagccctacaagtgcaatgagtgtgataaggtattcggacgcaagctgtacttaacaaaccatcagcgcatccataccggggaaaggccgtacaagtgtaatgcgtgtgggaaagttttcaaccaaaacccccacctcagtagacacaggaaaattcacgccggagagaattcacttcggacattgcagatggaatag

SEQ ID NO: 25599 - DNA, 1389 bp, Artificial Sequence
  Description of Artificial Sequence: Synthetic coding sequence
atgctgtgtgatgaggaggcgcaaaaacggaaagcaaaggagtcaggtatggctctcccccagggaaggttgaccttcatggacgtcgccattgaattctctcaggaggagtggaagtcattggatccagggcagagagccctctatagagacgttatgctggagaattatcgcaacctagtcttcctgggtatttgcctccctgatttgtctatcatctctatgctgaagcaacgacgagaaccactgatattacagtcacaggtgaaaatagtgaaaaatacagatggccgtgagtgcgtgcgctcagtgaacacagggagatcttgcgttttaggttcaaatgcagaaaacaaacccataaagaatcagctgggtctgacccttgaggcacatttatccgagctgcagttgttccaagctggacgcaaaatctaccggagtaaccaggtcgagaaatttacaaaccatcgcagctccgtgtctcctctgcagaagatttcctcaagttttacaacgcacatcttcaataagtacagaaacgacttaattgactttcctctactcccccaggaagagaaggcctatattcggggtaaatcttacgaatacgagtgcagtgaggatggggaggtcttcagagtgcgagcctctctgactaatcatcaggtcatccataccgccgagaagccatataagtgtacggaatgtggtaaagtcttctctcggaacagccacctggttgaacactggcgcattcacacaggccaaaagccttacaagtgctccgagtgcgataaagtgttcaatcggaacagcaatttggccagacaccagcgcatccataccggggaaaaaccacataaatgcaacgagtgtgggaaggcgtttcgagaatgcagtggcctcactactcacctggtaattcataccggggagaaaccctacaagtgtaatgagtgcgggaagaatttccggcacaagtttagcttaaccaatcaccagaggtcgcacactgcagagaaaccgtacaagtgtaacgagtgcggaaaagttttttccctgctttcttaccttgccaggcatcagattatccactccacagagaagccgtacaagtgtaatgagtgtggtagagctttccataagaggccgggactgatggcccatttacttatccataccggagagaaaccctacaaatgcaatgaatgcgataaggtctttggccgaaaactttatttaacaaatcaccagcgaattcatacgggcgagaggccctacaagtgtaatgcttgtggcaaggtctttaaccagaatccacatctctctcggcataggaagatacacgcaggcgagaattctctgcggacccttcagatggagtag

SEQ ID NO: 25600 - DNA, 1389 bp, Artificial Sequence
  Description of Artificial Sequence: Synthetic coding sequence
atgttatgtgatgaagaggcccagaagcgcaaggcaaaggaatctggcatggcgctgccgcaaggcagacttacattcatggatgttgcaattgagttttcccaagaggagtggaaatcgctggatcccggacagcgggcactataccgtgatgttatgctggaaaactaccgaaatcttgtgttcctgggcatctgcctccccgatctttcaataatatcgatgctcaaacagcgacgggagcccctgatactgcaatctcaggttaaaatcgtaaaaaacactgatggtagggaatgcgtgaggagcgtgaatacgggaagatcatgcgttctcgggtctaacgcggaaaataaacctatcaagaatcagctcggcttgacactggaggcccacctgagtgaactgcagctattccaggcaggacgcaagatttatagaagtaaccaggtggaaaaattcacgaaccatcgcagctcagtgagtccactacaaaagatctcttcatctttcacaactcacatatttaataaatacaggaatgacttgatcgactttccactcctgcctcaggaggaaaaggcatacatccgaggtaagtcctatgaatacgagtgctccgaggatggggaggtattcagagtcagagcttcactcaccaatcatcaggtgatacacacagcagaaaagccttacaagtgcacagaatgcggaaaggtgttctcccgtaatagccacctcgtggagcattggcgcattcacactggccaaaagccctataagtgtagtgagtgtgacaaggtctttaatcgcaactccaaccttgctcgccaccagcgtatccacaccggagagaaaccgcacaaatgtaacgaatgtgggaaagcatttagagagtgcagcggtttgacgactcacctggtgatccacaccggcgaaaagccctataaatgcaatgaatgtggtaagaactttcgtcacaagttctctctcactaaccatcaaaggagccacacagcagagaaaccttataagtgcaacgagtgcggtaaggttttttcattactgtcctaccttgcacgccatcaaatcatccattccacagagaagccttataagtgcaatgagtgtggaagagccttccacaaaagacctggtttgatggcacacttgctgattcacactggagaaaaaccttataagtgtaacgaatgcgacaaggtcttcggtaggaagctatacttgactaaccatcagcgaattcataccggcgaacgcccatataaatgcaacgcgtgtggcaaagtgtttaatcagaatccacatctgtcgagacatcgcaagatccacgcgggtgaaaatagcttaaggaccctgcagatggagtag

SEQ ID NO: 25601 - DNA, 1260 bp, Artificial Sequence
  Description of Artificial Sequence: Synthetic coding sequence
atgctgtgtgatgaggaagcacagaagaggaaagcaaaggaaagcggtatggccctgccccaagggaggctgaccttcatggacgtggcaattgagttctcgcaggaggagtggaagtcactggatccaggccagagagctttatatcgggacgttatgctggagaactataggaacctggtgtttctgggcagatcctgtgttcttggcagcaatgccgagaacaagcccataaaaaaccaactcgggttgaccctggaggcacacttatccgagctgcagttgttccaggcaggacgtaagatctataggtcgaatcaggtggagaaatttacaaatcatagaagtagtgtctcaccactccagaagatcagctccagcttcaccacacacattttcaacaagtacaggaatgatctaattgatttccctcttctgccacaagaggagaaagcctacatcagaggcaagtcctatgagtatgaatgctccgaagatggggaggttttccgagtacgggcaagcctgacaaatcatcaggtgattcacactgctgagaaaccctataagtgcaccgaatgcggcaaggttttcagtcgcaactcccacctcgtggaacactggcgcatccacacaggccaaaaaccatataagtgctcggagtgtgacaaggtgtttaacagaaatagcaacctggccaggcaccagagaattcacacaggcgagaagccacacaagtgtaatgaatgtggcaaagcttttcgcgaatgttcaggcctaactactcatctggttatccacacaggagagaagccttacaagtgtaatgagtgtggcaagaatttccggcacaagttctccctgaccaaccaccagaggtcacataccgccgagaaaccttataagtgcaacgagtgcggtaaggtgttcagcttactcagctatctggccaggcaccagatcatccactctacagagaagccctacaaatgtaatgagtgcgggagagcgttccacaagagacccggactcatggctcacttgctcattcacaccggtgagaaaccgtacaagtgtaatgagtgtgacaaagtgttcggtagaaagctttacttaacaaaccaccagagaatccacacgggtgaaagaccatataagtgcaatgcctgcggaaaggttttcaatcagaaccctcacctatcccggcatcgcaagatccacgccggagagaatagcttgaggacactccaaatggagtag

SEQ ID NO: 25602 - DNA, 2118 bp, Artificial Sequence
  Description of Artificial Sequence: Synthetic coding sequence
atgcttcgagaagaagctgcccaaaagagaaaaggtaaagaacctggaatggcacttccacaaggaagattgacattccgcgatgtagctattgagttcagcttggccgagtggaaatgcctcaacccatcacagagggctctgtatcgggaagtcatgctggagaattaccgaaacttggaagctgtggatatctcaagtaagtgcatgatgaaggaagttctcagcaccggtcaaggaaacactgaggtgatccatacaggaacactccagaggcatgaatcacaccacatcggcgatttctgcttccaggagatagaaaaagaaatccacgatattgaatttcagtgtcaggaagatgagcgcaatggattagaagcacctatgacaaaaatcaagaagctgaccgggagcacagaccagcatgaccaccgtcatgcagggaacaaaccaattaaagatcagcttggaagcagcttttacagtcacctccctgagctgcacatttttcagatcaagggtgaaatcggcaaccagttggaaaagagcactaatgacgcccctagcgtgtctacattccagcggatttcatgcaggccacaaacgcaaatcagcaacaattacggtaataacccactgaacagttccctgcttccccagaaacaagaggtacacatgagagaaaaatctttccaatgcaacaaatcaggcaaagcatttaattgtagttctttgctcaggaaacatcaaatcccgcaccttggagacaaacagtacaagtgcgacgtctgcgggaagttgtttaatcacgagcaatacttagcatgccatgacaggtgtcacacagtcgagaagccctacaagtgcaaagagtgcgggaaaaccttctcacaggaatcctcgctcacctgtcaccgtaggctgcatactggtgttaaaagatataattgtaatgaatgtggcaaaatctttggccaaaactcagccttgttaatagacaaagccatcgatactggtgagaatccctataagtgtaatgaatgcgataaagccttcaaccagcagtcgcagcttagtcatcatcgaatccatactggcgagaagccatacaagtgcgaggagtgcgacaaagtgttcagccgaaaatccaccattgagactcacaagaggatccacaccggggagaaaccctacaggtgtaaagtgtgcgacaccgcattcacctggcactctcaactggccaggcatcgaaggattcatacagcaaagaaaacatacaagtgtaacgaatgcggaaaaacattcagccacaagtcatccctggtgtgccaccaccgcctgcatggcggtgaaaaatcatacaagtgtaaagtttgtgacaaggccttcgtctggtcatcccagctcgccaaacacactagaattgactgcggggagaagccatataaatgcaatgaatgcggaaagacattcggccaaaactctgacctgctgatacacaaatcaattcacacaggcgaacagccttataaatgcgacgagtgcgagaaggttttttctcgcaagtcttctttagaaacccacaagataggccataccggagaaaagccgtacaagtgcaaggtgtgtgataaagcttttgcctgccactcctacttggctaagcatacacggatccacagcggagagaaaccatataagtgcaatgagtgttcgaagacgttttcccatagatcatacctggtctgccatcaccgagtgcattccggcgagaagccatacaagtgcaacgagtgtagtaaaaccttctcgaggagaagtagtctgcactgtcatcggagactgcatagtggagagaagccctataagtgtaatgaatgtggcaataccttccggcactgttccagcttaatttatcatagaagattgcacaccggcgaaaaaagttacaaatgcacaatctgtgacaaggctttcgtacggaactcactcctgagtaggcatacacggatccacaccgcagagaagccttataaatgcaacgagtgcggcaaggctttcaatcagcagtcccaccttagcagacaccatcgaatacataccggcgagaagccctag

SEQ ID NO: 25603 - DNA, 1911 bp, Artificial Sequence
  Description of Artificial Sequence: Synthetic coding sequence
atgatgaaagaggtcctttctaccggccagggaaacaccgaggtgatccataccggcaccttacaacgccatgagtcgcaccacatcggcgatttctgctttcaggagatcgagaaggagatacacgacatagagtttcaatgtcaggaggatgagcgcaacggactagaagccccaatgaccaaaataaaaaaactcacaggaagtactgatcaacacgaccaccgtcacgctggaaacaaacctattaaagaccagttgggttcatctttttacagccatttgcccgagttgcacatttttcaaatcaagggagagataggcaatcagctcgagaagtccaccaacgacgctccttccgtgtcaacgttccagcgcattagttgcaggccgcaaacccagatcagtaacaactacggaaataacccattaaatagcagtctcttaccacaaaagcaagaggtccatatgagagaaaagtcattccaatgtaataagtccggaaaggcatttaactgctcctctctgttgcgaaagcaccaaatcccccacctgggtgataagcagtataagtgtgatgtgtgtgggaaactgtttaatcatgagcagtatttggcatgccatgatcgctgccacaccgtagagaagccatataagtgtaaggaatgtggtaagactttctcccaggagtcttcactgacctgtcaccggaggctgcacaccggcgtgaagaggtacaactgcaacgagtgcggtaaaatattcggccaaaatagcgctctcttgatcgacaaagccatcgacaccggggaaaacccatacaagtgcaacgaatgtgacaaggcattcaatcaacagagtcagctgtctcaccatcgaattcatactggggaaaaaccatacaaatgtgaggaatgtgataaggtgttttcccgcaaaagcaccatcgaaacccacaagcgaatccacacgggagaaaagccctacagatgcaaagtgtgtgacactgctttcacatggcactctcagctggcacgccataggaggattcacactgccaaaaaaacatataagtgcaatgagtgcggaaagactttttcacacaagtctagcctggtgtgtcaccacaggttgcacggcggagagaagtcctataagtgcaaagtctgtgacaaggcctttgtctggagctcacagctggcgaaacacacgcggatagactgtggggaaaaaccttacaagtgcaacgagtgcggaaaaaccttcggacagaattccgacctgttaattcacaagagcatccacacaggcgaacagccatataagtgtgacgagtgtgaaaaagtgtttagtcgaaaaagtagtctggagacgcacaaaatcggccacactggagagaagccatataagtgtaaagtgtgtgacaaggcattcgcttgccactcttatctggcaaaacatacacgaatccactcaggggagaagccttacaagtgtaacgaatgtagcaagacatttagtcatagaagctatctcgtgtgccatcatcgtgtgcacagtggggagaaaccatacaagtgtaacgaatgtagtaaaaccttttctcgcaggagctccctgcattgccatcggcgtctccattcgggcgagaagccctacaagtgcaacgaatgtgggaatacattccgacattgttcttctttgatatatcaccgtagactgcatacgggagaaaagtcctacaagtgtactatttgcgacaaagctttcgtgaggaattctctcttgtcccggcataccagaattcatacagcagagaagccttacaagtgcaatgagtgcgggaaggcttttaaccaacagagccacctgagcagacaccaccggatacatactggggagaaaccttag

SEQ ID NO: 25604 - DNA, 2118 bp, Artificial Sequence
  Description of Artificial Sequence: Synthetic coding sequence
atgttgagagaggaagccgctcagaagcgcaagggcaaggagccagggatggcactgcctcagggccgtcttacattccgggatgtcgctatcgagttcagtcttgcggaatggaaatgtctgaatccctctcagcgggctctataccgcgaggtaatgctggagaattatagaaacctcgaagcagtcgacattagttctaagtgtatgatgaaggaggtgctgagcaccgggcagggcaatacagaggtgattcacacaggcaccctccaacgccatgagtcacaccatatcggagacttttgtttccaggaaatagaaaaagagatccatgacatcgaatttcaatgccaggaagacgagcggaatggcctggaagctcccatgaccaaaataaagaaactgaccggatcgacggaccagcacgaccatcgccacgccggtaacaagcctatcaaagatcagctcggatcttctttctatagccatcttccagaattgcatattttccaaattaagggagagattggaaaccagctcgagaagtcaacaaatgatgcacccagtgtgagcacttttcaaaggatcagctgcaggccccagacacaaatcagtaataattacggcaataaccccttgaacagctccctccttccccagaaacaagaggtgcatatgagggaaaaaagcttccagtgtaataaaagcggaaaggcttttaactgtagctccctgttgcggaaacaccagatacctcacctcggcgataagcagtacaaatgtgacgtatgcgggaagctgtttaaccacgaacagtacctggcttgtcatgaccgatgccataccgttgaaaaaccctacaaatgtaaagagtgcggtaaaacttttagccaagaatcctcactcacttgtcaccgtaggctccatacaggcgttaaacgctacaattgcaacgagtgcgggaagatattcggccagaactcagcactcctgatcgacaaagctatcgacactggagagaatccttacaaatgtaatgaatgtgacaaggcctttaatcagcaatctcagttgtctcatcatcggatccacacaggcgagaagccctacaagtgcgaagagtgcgacaaggttttttctaggaaatccaccattgagacccataaacgcatccacactggggagaagccctatcgatgcaaagtctgtgacaccgcatttacatggcactctcagctggcgaggcacaggcggatacatacagcgaagaaaacttacaaatgtaacgaatgtggcaagacatttagccacaaatccagcctggtttgccaccaccgacttcacggaggcgagaagtcttacaaatgcaaggtgtgcgacaaagccttcgtgtggtcaagccagttagctaagcacacacgcatcgattgtggggagaagccttataagtgcaacgagtgcgggaaaacgttcgggcagaattctgacctgttgattcacaagtcaatccacactggagagcaaccctataaatgcgatgagtgcgagaaggtgttttcccgcaagtcgagccttgagactcacaaaatcggccatactggcgagaaaccatataagtgtaaggtgtgtgacaaggcattcgcctgccattcatacctggccaaacacaccagaatccacagcggagaaaaaccatacaaatgcaacgagtgctcaaaaacatttagccaccgcagctatctggtttgccaccacagagtgcatagtggagaaaagccctacaagtgtaatgaatgcagcaaaaccttctcacgcagatcctcgctacactgccaccggagactgcactcaggggaaaagccttacaagtgcaatgagtgcgggaatactttcagacattgtagctcgctcatataccaccgcaggctccacaccggtgagaaatcttataagtgtacaatttgtgacaaggcctttgtacggaactcgctgctctcacgtcatactaggatccacactgccgagaaaccctataaatgtaatgagtgtggcaaggccttcaaccagcaatcacatttgagccggcatcaccgcatacacacgggagaaaaaccgtag

SEQ ID NO: 25605 - DNA, 2118 bp, Artificial Sequence
  Description of Artificial Sequence: Synthetic coding sequence
atgttgagagaggaagccgctcagaagaggaagggaaaagagcccggtatggcactgccacaaggaaggttaacctttcgcgacgtggcaatcgagttctccttagcggagtggaagtgcctgaacccaagtcagcgggcactgtatagggaggtcatgctcgaaaattatcggaaccttgaggccgtcgacatttcaagcaaatgcatgatgaaggaggtactctccacagggcaggggaacaccgaagtaatccacacaggaacactccagaggcatgagtcccaccacattggtgacttctgctttcaggagattgagaaagagatccacgacatagaatttcagtgccaggaggatgagaggaacggactggaggccccaatgaccaaaatcaagaaattgactggatcaacagatcagcacgaccacagacacgcgggtaacaaacccattaaagaccaacttggctcctcattttatagccacttgccagaattgcacatatttcagattaaaggtgagattgggaatcagctggagaagagtacaaatgacgccccatccgtcagtacgtttcagcgcatcagttgcaggcctcagacccagatttcaaataattatgggaacaacccacttaacagctctctgcttccacagaagcaggaagtgcatatgcgagagaaaagctttcagtgtaacaagtcaggtaaggctttcaattgctcttcccttttaaggaagcatcagatcccacacctgggggataagcagtataagtgcgacgtatgcggcaagctcttcaatcacgaacagtatctcgcttgtcacgatagatgccatacagtcgagaagccgtacaaatgcaaggagtgtggcaaaactttctcccaagagtcctctctaacatgccaccggagattgcacaccggggtgaagaggtacaactgtaatgagtgtggcaaaatattcggccagaatagcgcgttgctgatcgacaaagctatagataccggagaaaacccgtataagtgcaacgaatgtgataaagcatttaatcaacagagccagctgagccatcatagaattcatactggcgagaaaccttacaaatgcgaagaatgcgataaagtgttttcacgaaagtctacgatcgaaacacataagcgaattcacaccggtgaaaagccctaccgctgcaaggtttgcgatacagcctttacatggcactcgcagcttgccaggcatcgtaggattcacacagccaaaaagacatacaagtgtaacgaatgcgggaagacgttctcacacaaatcctcgctcgtgtgtcatcatcgcctccatggtggagaaaagagctacaaatgcaaagtctgcgataaagcctttgtgtggtcatcgcaactcgccaagcacacacgtattgattgtggcgagaaaccatataaatgcaatgaatgcggcaaaacttttggacaaaatagcgacctcctgattcataagtcgatccatacaggcgaacagccctataagtgtgatgaatgcgaaaaggtgttcagcaggaagagcagcctggaaacacacaagattggccatacaggcgaaaaaccctacaaatgcaaagtgtgtgacaaggcattcgcctgccacagttacctcgcaaaacataccagaatccacagcggagagaaaccgtacaaatgcaacgaatgtagcaagacgttcagtcaccgctcttacctggtttgtcatcaccgggtgcatagcggcgagaagccgtacaaatgtaatgagtgttctaagacattctccagaaggagttcactccactgtcaccgaaggctgcattctggtgagaaaccctataaatgtaatgagtgtggtaatactttcagacactgttcgtccctaatctaccatcgaaggctgcataccggggaaaaatcctacaagtgcacaatatgtgacaaggcgtttgtccgtaattcgcttctgtctaggcataccagaatccatacagcggagaaaccatacaagtgtaatgaatgcgggaaggccttcaaccagcagtctcaccttagtcgacatcacaggatccacacaggagaaaagccatag

SEQ ID NO: 25606 - DNA, 1854 bp, Artificial Sequence
  Description of Artificial Sequence: Synthetic coding sequence
atgataaagtcccaggaaagtctgaccctcgaggatgtggctgtagagttcacttgggaagaatggcagcttctcgggccagcacagaaggatttgtatcgagatgtaatgctcgaaaattattccaacctagtctcggtaggttaccaggcatctaaacccgatgcccttttcaagctggagcagggcgagccatggaccgtcgagaacgagatccatagccaaatctgtcccgagattaagaaggttgataaccacctgcagatgcacagccagaaacagcggtgtctcaaacgcgtggaacagtgccataagcacaatgccttcggcaacatcatccaccagaggaagtccgacttccccctgaggcagaatcatgataccttcgatcttcacgggaaaatcctaaaatctaacctgtcccttgtgaatcaaaataaaaggtatgaaattaagaacagcgtgggagttaatggcgatggcaagtcgtttcttcatgctaagcatgaacaatttcacaatgagatgaacttccctgagggcggtaactccgtaaataccaattctcagtttatcaaacaccagcgtactcaaaatatagacaagcctcacgtatgtactgagtgcgggaaagcttttctgaaaaaaagcagactcatatatcaccagcgggtccacaccggtgaaaagccccatggatgctctatttgtgggaaggccttttccaggaagtccggattaacagaacaccagcggaaccatacaggggagaagccctatgagtgtactgaatgtgataaggccttcagatggaagtctcagctgaatgctcaccagaaaattcacaccggtgagaagtcatacatttgctctgactgcggtaaaggctttatcaagaaaagtaggctcataaaccatcagagggtgcacaccggagaaaagccccacgggtgtagcctgtgcggcaaggccttctccaaaaggagcagattgactgagcaccagaggacccataccggcgaaaaaccctatgagtgtacggagtgcgacaaggccttcaggtggaagtcccagctcaatgcacaccagaaagcacacacaggggaaaaatcctacatctgtagggattgtggaaaaggatttattcaaaagggaaatttgattgttcaccagcggatccacacaggtgaaaagccctatatctgcaatgagtgtggaaaggggtttatccagaaagggaacctgctaattcacagacgcacccacaccggtgaaaaaccatacgtgtgcaacgaatgtggcaaaggattcagccaaaaaacgtgtctcatttcacaccaaaggtttcacaccggtaaaacaccatttgtttgcaccgaatgcgggaaatcgtgcagccataagagtggcctcatcaaccatcagcgcattcataccggagaaaagccctacacatgttctgactgcggcaaggcctttagggataaaagttgcctgaatcgacaccgcaggacacatacaggtgaaaggccctatgggtgctcggactgcggcaaggcttttagtcacctgtcttgtctggtgtatcacaagggcatgctgcatgccagggaaaagtgtgttggatctgtgaagcttgagaacccctgcagcgaatctcattcgttgtcccatacccgagacctcatacaggacaaagactcggtcaacatggtcaccctacaaatgcccagcgtggcagcccagactagccttaccaactctgcattccaggccgaatccaaggttgccattgtgtcccagcccgtggcaaggagctcggtgagtgcagactcccgcatctgcaccgaatag

SEQ ID NO: 25607 - DNA, 1746 bp, Artificial Sequence
  Description of Artificial Sequence: Synthetic coding sequence
atgctggagaattactcaaacttggtctctgtgggatatcaggccagcaagccagatgcactatttaagctggagcagggagaaccctggacagtcgagaacgaaattcattctcagatctgccccgagattaaaaaggttgacaaccatctgcagatgcacagccagaagcagaggtgcctgaagagggtcgagcagtgccataagcataatgcgttcggcaatatcatccaccaacgaaagtctgatttcccactacgccagaatcatgacaccttcgatctgcatggcaaaatcctgaaaagcaacctgtccctcgtgaaccaaaataaacgctatgagattaaaaactctgtgggtgtaaacggggacggaaagtcttttcttcatgcaaaacacgaacagtttcataatgagatgaatttcccagaggggggtaactcggttaatacaaatagtcagttcatcaaacaccaaaggacacagaacattgataaacctcatgtgtgtacagagtgtggaaaagccttcctaaagaaaagccggttgatctatcaccagcgggtacataccggtgagaagccacacgggtgttccatttgcggaaaggcttttagccgaaagagcggtctgacagagcaccagcggaatcatacaggcgaaaaaccatacgagtgcaccgaatgtgataaggcttttcggtggaaaagccagctgaatgctcatcagaaaatccacacaggtgagaaatcctatatttgtagtgactgcggtaagggctttatcaagaaatctaggttgattaaccatcagagagtgcataccggagagaagcctcacgggtgtagtctttgcggtaaggccttttcaaagagaagtcgactgaccgagcatcagcgcacacatactggagaaaaaccctatgaatgcaccgagtgtgacaaggccttccgctggaaatctcagcttaacgctcatcaaaaagcccacacgggcgaaaagagctatatttgtagggactgtggcaaagggttcattcagaaagggaaccttatcgtacatcaacgaatacacacaggagagaaaccctacatatgcaatgaatgcggaaagggcttcattcaaaagggcaatctactgattcatcgcaggacgcacacaggagaaaaaccctacgtctgtaacgagtgcggcaagggattttcccagaaaacttgtctcatttcccaccagcgctttcacacaggtaagacacccttcgtctgcacagagtgtggcaagagctgctcacacaagagcggcttaatcaatcaccaacgaatccataccggtgagaaaccatacacatgcagcgattgcggcaaagcgtttcgtgacaagagttgcctgaaccgccacaggaggacccacacgggagaacgcccttatgggtgctcagactgcggcaaagcattttcccacctgagctgtcttgtctatcataaagggatgctgcacgccagggaaaaatgcgtcggctcagtgaaactagagaacccctgctcggagtctcacagcttgtctcacactagggacctgattcaggacaaagacagcgtgaatatggtgactctgcagatgccaagtgttgcagctcagacaagcctgacaaatagcgcttttcaggccgaaagcaaagtggccatcgtctcgcagccagtggcaaggagctcggtaagcgccgattccaggatctgcactgagtag

SEQ ID NO: 25608 - DNA, 933 bp, Artificial Sequence
  Description of Artificial Sequence: Synthetic coding sequence
aagcggagccgcctcaccgagcatcagaggactcacactggggaaaaaccatacgagtgtaccgagtgtgacaaggccttcagatggaaaagccaattaaatgcccaccagaaagcccataccggtgagaaaagctatatatgtcgggattgcggaaagggttttattcagaaaggcaatctcatagtccaccagcgcattcacaccggtgagaagccgtatatttgcaacgaatgcggaaagggcttcatccagaagggaaacctgctgatccaccggagaactcataccggggagaagccttacgtgtgcaatgagtgtggaaagggatttagccagaagacctgcttaatttcccatcagcgcttccacacaggcaagacccccttcgtatgtaccgagtgtgggaaatcttgtagccacaagtccggtttgatcaaccatcaacggattcacactggcgagaaaccttacacttgctctgactgcggaaaggcctttagggacaagtcatgtcttaaccggcataggcgcacgcacaccggtgagaggccatatggctgctctgactgcggaaaagccttctcccatctttcctgcctggtatatcacaaaggtatgctgcacgcccgagagaagtgcgtgggcagcgtgaaactcgaaaacccttgttcagagtctcactctctttcccatacgagggacttgatccaggacaaggactctgttaacatggtgaccctgcagatgcccagcgttgccgctcagacctcccttactaacagcgccttccaggccgagtcaaaggtagccatagtgtctcagccagtcgcaagatcttccgtaagtgctgacagcagattcgcccaaaacaagaaccatatgaacgcggtgaacgtggtagtgcttagcgttattaattatattatatag

SEQ ID NO: 25609 - DNA, 1758 bp, Artificial Sequence
  Description of Artificial Sequence: Synthetic coding sequence
atgatcaagacccaagagagcctgaccttagaagacgtagcagtggaatttagctgggaggagtggcagctgttggacaccgcacaaaagaacctctaccgggacgtcatggtggaaaattacaaccatttggtgagtttgggttaccagacaagtaagcctgacgtcctgtccaagctggcacatggtcaggagccttggacaaccgacgctaagattcagaacaaaaactgccccggaatcggtaaagtggattcccatctccaggaacactctcccaaccagagacttttgaagagtgtgcagcagtgtaatggacagaataccctgaggaatattgtgcacctgagtaaaactcatttccccattgttcaaaatcacgatacatttgacttgtacagaaagaacctgaaatctagcctttctctcataaaccagaagagacgacatgggataaacaacccggtcgagttcatcggaggggaaaagactctgttacatggaaagcatgaacgcacacacacaaagacaaggtttagcgagaacgcaaagtgcattcatactaaatttcaggtcttcaaacaccaacgaacacaaaaaattgaaaaaccgcacgcatgcattgaatgcgaacaaaccttccttcgcaagtcacagctgatctaccacgagaatatctgcatacaggagaatcccggtagcggccagtgcgagaagcttagtcgcagcgtgctgttcacgaagcatctgaaaacaaacacgaccgataagatctgtattcccaatgaatacagaaagggtagcaccgtgaagagtagcttgataacccaccagcagactcacacggaggaaaagagctacatgtgctctgagtgcggaaagggctttacgatgaagaggtatcttatagcccatcaaaggacacattccggcgaaaagccatacgtttgcaaggaatgcggaaagggcttcacagtgaagagcaacctgatagtgcatcagagaacccatactggcgaaaaaccctatatctgctctgagtgcgggaaagggttcaccatgaagcgctatctggtcgtgcatcagagaacccatactggggaaaaaccatatatgtgctcagaatgcgggaaggggttcactgtgaaatccaatctaattgtccaccagcggtcacatacaggcgagaaaagttacatttgtagcgaatgcggaaaggggtttactgtgaagagaaccctggtcattcatcaaaggacacacacaggcgagaaaagctacatatgtaacgagtgtgggaagggattcacaaccaaaaggacgctaattatacatcagcgcactcatacaggtgagaaaccatatgaatgtaacgaatgcggcaaagcctttagccagaagatttgcctcatacaacacgaacgctgccacactggaaaaacaccttttgtctgcacagaatgcggaaaaagctattctcacaaatacggactcattacacatcaaaggattcatacaggtgagaagccttacgaatgtaacgaatgcgggaaggccttcaccactaagagtgtgcttaatgtgcaccaaaggacccacactggcgagcggccatatggttgctccgactgcgagaaggctttctctcatttaagtaacctagtcaagcataagaaaatgcatacacgagagatgggaaggatatctcaggtggagaattcgtgtaacggcgagtcacaactgctgccttataagtag

SEQ ID NO: 25610 - DNA, 597 bp, Artificial Sequence
  Description of Artificial Sequence: Synthetic coding sequence
atgattaagacacaagagagtcttacccttgaggatgttgccgtggaattctcctgggaggagtggcagcttcttgataccgctcagaaaaatttgtatcgggatgtcatggttgaaaactacaaccatctggtgagtttgggctaccagaccagcaaaccagatgttctttccaagttggcacacggacaggagccttggacgacggacgcaaaaattcaaaataaaaattgtcccggtatcgggaaggtagacagccatctccaggaacatagtcccaaccagcgcctgctcaagtccgtacagcagtgcaacggccaaaacacgctgaggaatattgtacacctctctaagacacacttccccattgttcagaatcatgataccttcgacttgtatcgcaagaatcttaagtcttccctcagcctcataaatcagaagcgcagacatggaattaacaaccccgttgagtttattggcgagacagggtctctcgaacggcctagacaggcagaccacttgcggagcgaagtgcaggaccagcccggtcagaggggagaaacactgtgtcttctcaaaatccatactaaaaattag

SEQ ID NO: 25611 - DNA, 2226 bp, Artificial Sequence
  Description of Artificial Sequence: Synthetic coding sequence
atgaccgcacaggagagtttaaccctggaggacgtcgcggtggattttacatgggaagagtggcaattcttaagccctgcacagaaggatctttatcgcgatgtaatgcttgagaactacagcaacttagttgcagttggctaccaggcttctaagccggacgctctctctaagctagagcgaggagaggaaacatgtaccactgaagacgaaatttattccaggatttgctctgacagtgggggtgctagtggaggcgcatacgcagagataaggaaaattgatgatccgctccagcaccatttgcagaatcagtcaattcaaaagtcggtgaaacagtgtcacgaacagaatatgtttggcaacatcgtgaatcagaacaaaggccatttcctgctgaaacaggattgcgacacttttgacttgcacgagaaacctttgaagagcaacctgtcttttgaaaaccagaagcggtcctcgggacttaagaatagcgctgaatttaaccgggacggaaagtctcttttccatgccaaccacaagcaattttacacagaaatgaagttccccgcaatcgcaaagcctatcaacaagagtcagttcatcaaacagcaaagaacgcacaacattgagaacgctcatgtgtgcagtgaatgtggtaaggctttcctgaagctctcccagttcattgaccaccaacgcgttcataccggagagaaaccccacgtttgcagcatgtgtggcaaggcttttagcagaaaatctaggttaatggaccaccagcgcacacataccgaactgaagcattacgaatgcacggagtgtgataagacctttttgaaaaaaagtcagcttaacattcatcagaagacacacatgggaggtaagccctatacgtgttcgcagtgcggaaaagcctttattaaaaagtgtcggctgatctaccaccagagaacacacacaggcgaaaagcctcatggatgttctgtgtgtggaaaggccttctcaaccaaatttagtctcacaacacaccagaaaacacatacaggggaaaagccatacatatgtagcgaatgcgggaagggtttcatcgagaagcgacggctcacagcccaccatcggacgcacacgggggagaagccatttatctgtaacaaatgcggaaaaggctttaccttgaagaacagtctcatcacacatcagcagacacacaccggcgagaagctctatacttgcagcgagtgtgggaaggggttttcaatgaagcactgcctgatggttcatcaaaggactcatacgggggagaagccctataaatgcaacgagtgcgggaaaggcttcgctttgaaatcacctttgatacgacaccagaggacacacaccggtgaaaaaccatacgtgtgtaccgaatgtagaaaaggcttcaccatgaagtcagatctgatcgtgcatcaaagaacgcatacagcagagaagccttatatctgcaatgattgcgggaaaggcttcaccgtcaaatcgaggctgatcgtacaccaaaggacccacacaggggagaaaccctatgtgtgcggcgaatgcggaaaaggcttccccgctaaaattagattgatggggcaccaaaggacacatacaggagagaaaccctatatttgcaatgagtgcgggaagggctttactgaaaagtctcatctgaatgttcaccggagaactcatactggagagaaaccgtacgtgtgcagcgagtgtggcaaaggcctgacaggaaagagcatgttgatcgcccatcaacggacacatacgggggagaaaccgtatatttgcaacgagtgcggcaaaggcttcactatgaagtcaaccctgagtattcatcagcagacccacacgggcgaaaagccatacaagtgtaatgagtgcgacaagaccttccggaagaagacttgtctgatccagcatcagaggttccacaccgggaagacctcattcgcctgtacggaatgcggaaagtttagcttacggaagaacgaccttattacccatcaacggatccacactggtgagaagccctacaagtgcagcgactgcggcaaggctttcaccactaagtccggccttaatgtgcaccagcgaaagcatacgggtgagcggccatacggctgctctgactgcggaaaggcattcgcccatctgtccattctcgtaaagcataggagaatccaccggtag

SEQ ID NO: 25612 - DNA, 2196 bp, Artificial Sequence
  Description of Artificial Sequence: Synthetic coding sequence
atgatgcaagcgcaggagtccctcaccttggaggacgttgccgtggacttcacgtgggaggagtggcagtttctgtccccagctcaaaaagacttatatagggatgtaatgctggagaactactccaacctggtcgcagtgggatatcaggcttctaagccagacgctcttagcaaacttgaacggggagaagagacatgtactacggaagacgagatctatagtcggatctgctctgagatccgcaagatcgacgatcctctccagcatcacctccagaaccaatctatacaaaagtccgtgaaacagtgccacgagcaaaatatgtttgggaacattgtgaaccagaacaagggccactttctactcaagcaggactgtgacacttttgatctgcatgagaagcccctgaaaagcaacctgtccttcgaaaatcaaaaacgaagctcagggctgaagaacagcgcggagtttaatcgggacggaaaatctctgtttcacgccaaccataagcaattctatacagaaatgaaatttcccgcaatcgctaaacccatcaataagagccaattcataaaacagcaacggactcataacatcgagaacgcccatgtttgctccgaatgtgggaaagcctttctgaaactgagccagttcattgaccaccaacgggtacacacaggcgagaagcctcatgtgtgctccatgtgtggaaaggccttctcccggaaatccaggctgatggatcaccaaaggacacacactgagctgaagcattacgaatgcaccgaatgtgacaagacatttctgaagaaaagtcagctgaatattcaccagaaaactcacatgggcggtaagccttacacatgcagccagtgcggcaaggcctttattaaaaaatgtaggcttatctatcaccagaggacccacactggagagaaaccacatggatgttccgtgtgcggcaaagcattctcaacgaagttctcacttacgacacaccagaagacccatactggagagaagccatatatctgtagcgaatgtggaaagggctttatcgagaaacggaggttgaccgcccaccaccgcactcacactggcgagaaacctttcatctgcaataagtgcggaaaaggattcaccctgaagaacagcctaatcacccatcaacagacccatactggagagaaactgtatacctgctccgaatgtgggaagggattctctatgaaacactgtctgatggtgcatcagcggactcatacgggagaaaagccatacaagtgtaacgagtgtggcaaaggctttgcccttaaatctccactgattaggcatcagcggacgcacactggtgaaaaaccgtacgtgtgcaccgaatgccggaaggggtttaccatgaagtccgatctgatagttcatcagcggactcataccgctgagaaaccttacatctgcaacgattgcgggaaaggttttaccgttaagtctagacttattgtacaccagcgaacccacactggagagaagccctacgtctgcggcgagtgcggcaaggggtttcctgcgaagatacgactcatggggcaccagagaacccacacgggtgagaagccttacatctgtaatgaatgtgggaagggttttaccgagaagtctcatctgaacgttcaccggcgaacccacacaggggaaaagccgtatgtctgctctgaatgcgggaagggcctgaccggtaaaagtatgttgatcgctcaccagcgaacgcacacaggtgagaaaccttatatctgcaatgaatgcggtaaggggttcacaatgaaatctacactctcgatccatcagcagacacatacaggggaaaaaccctataagtgcaacgagtgtgataaaacttttcggaagaagacatgtctgattcaacatcagcgcttccacacgggtaagacttcttttgcatgtaccgagtgcgggaagttttctttgcggaagaacgatctgatcacccaccaacgtatccacacaggcgagaaaccgtataaatgttcagattgcggtaaggcgttcaccactaagtccgggctgaatgttcaccagcggaaacacactggcgaaagaccatacggatgctccgactgtggtaaggctttcgcacacctaagtatcttggttaaacatcgccgtattcataggtag

SEQ ID NO: 25613 - DNA, 2058 bp, Artificial Sequence
  Description of Artificial Sequence: Synthetic coding sequence
atgacagcccaggaaagcctgaccctcgaagatgtcgccgttgattttacctgggaggagtggcaattcttgagtcctgcccagaaggatctgtatcgtgacgtgatgctggaaaattacagcaatctcgtcgccgtggggtatcaagcctcaaagccggacgcactgtctaaactggagcggggagaggaaacctgtacaactgaggacgagatttactcacggatctgcagtgactccgggggagcctctggaggggcatacgctgagatacgcaaaatcgacgatccccttcaacaccatctccaaaatcagtccatccagaagtctgttaaacagtgccacgaacagaatatgttcggtaacatcgttaaccagaataaggggcacttcctgctgaaacaggactgcgacacatttgatttgcacgagaagccattgaaaagtaatctctctttcgaaaaccagaagcggtcatctggtttgaaaaactccgccgagttcaatcgggatgggaaatcgctttttcatgccaatcacaagcaattctacactgaaatgaaatttccagccatcgccaaacccatcaataaatctcagttcattaagcagcaaagaactcacaatattgagaacgcccacgtgtgctctgaatgcggaaaggctttcctcaagctctcacagttcattgatcatcagagggttcacaccggagaaaaaccacacgtgtgttccatgtgtggcaaagccttctctcgcaagagcaggcttatggaccaccaaaggactcataccgagctgaaacactatgagtgcactgagtgcgataagacgtttttgaagaaatctcagcttaatattcaccagaagacccatatgggtggcaagccatacacctgcagtcagtgtggaaaggcttttatcaaaaagtgcaggttgatctatcatcagagaacacatactggagaaaagcctcatggctgcagcgtgtgcggcaaagccttttcaacaaagttcagccttactacacatcagaaaacccatacgggcgaaaagccgtacatctgtagcgaatgtggaaagggctttatcgagaaaaggcgcctgaccgcccatcatcgaactcatactggagagaagccatttatttgtaataaatgcggcaagggatttactcttaagaacagtctgattacgcatcagcagacgcacaccggcgagaaactgtacacctgcagcgagtgcggcaaggggttttctatgaagcattgcctgatggttcatcagaggacgcacaccggtgaaaaaccatataaatgtaacgagtgtggaaagggattcgctttaaagtcacccctgatccgccaccagcgtacacacactggagagaagccttacgtatgtaccgagtgtcgaaaaggatttaccatgaaatccgatctgattgttcaccagaggacccataccgccgaaaaaccctacatttgcaacgactgtgggaagggcttcacagtgaaatcacgcctgatcgtgcatcaacggactcacacaggcgaaaaaccttacgtgtgtggagagtgcgggaagggcttccctgctaaaattcgattgatgggccatcagagaacccacaccggggagaaaccatacatttgcaacgagtgcgggaagggcttcacaatgaagtccaccctgagcatccaccagcagacacacacgggggaaaagccctacaagtgcaatgaatgcgataaaacgttcagaaagaagacttgtcttatccagcatcagaggtttcataccgggaaaacatctttcgcctgtactgagtgcgggaagttctcgctgcgtaagaatgatctgatcacacatcagaggattcacactggtgagaaaccatacaaatgctcagattgcggtaaagcttttaccaccaagagcggcctcaacgtgcatcagcgcaagcatacgggcgaacgcccttacggatgtagtgactgcggcaaggcattcgctcacctcagtatcctggtaaaacacaggcggatccaccgctag

SEQ ID NO: 25614 - DNA, 2211 bp, Artificial Sequence
  Description of Artificial Sequence: Synthetic coding sequence
atgcggcctgaaccaacaaaattttgggaggagtccctgactcttgaggatgtggctgttgactttacatgggaagagtggcagttcttgtcgcctgcacagaaagatctctatagggatgtgatgcttgaaaattactcaaatttggttgctgtgggctatcaggctagtaagcctgacgcattgtcaaagctggaacgcggagaggagacttgtaccaccgaggatgagatctactcccggatctgttcagaaatcaggaagatagatgatcctctccagcatcacttgcagaatcagagcatccaaaagagtgtgaagcagtgccacgagcagaacatgttcgggaatatcgtgaaccagaacaagggccattttctcctcaagcaggactgcgatacattcgacttgcatgagaaaccactgaagtcaaacctttcttttgagaaccagaaacgatccagcgggctcaagaactctgcggaattcaaccgtgacggcaagtctcttttccacgccaatcacaagcaattttataccgagatgaaatttcccgctatagcgaaaccaatcaacaaaagtcagtttatcaaacagcagcggactcataatatcgaaaatgctcatgtttgctccgagtgcggaaaagccttcctcaaactttctcagtttatagaccaccaacgcgtgcacactggcgaaaaaccacacgtgtgctctatgtgtgggaaagctttcagtcgcaaatcacgactcatggatcaccagaggacgcatacagaacttaaacattacgagtgtactgaatgcgataagacttttctcaagaagagccagctcaacatccatcagaaaactcacatggggggaaagccttacacctgctcacaatgtggaaaagcatttatcaaaaagtgcaggcttatctatcaccaacgaacccacaccggcgagaagcctcacggctgttctgtctgcgggaaggccttttctaccaagttttctttgactacccaccagaagacacacaccggggaaaagccatacatctgcagtgaatgtggaaagggttttatcgaaaaacgcagactgaccgcccatcataggacacacaccggcgaaaaacccttcatttgtaataagtgcggcaagggtttcacgctgaagaactccctgatcacccatcaacagactcatactggagagaaactctatacttgtagcgagtgcggcaaaggattttctatgaaacactgcctcatggtgcatcaacggactcatacaggcgagaagccctacaagtgcaatgagtgcggcaagggttttgcccttaagtcaccccttatccggcaccagcgcacgcatactggtgaaaagccatacgtgtgcaccgagtgccggaaaggcttcacaatgaagtctgatctgatcgtccatcagaggactcataccgcggagaaaccgtacatttgtaacgactgcggaaaaggctttacggtgaagtccagactcatagtgcatcaacggacccacactggagagaaaccatatgtgtgtggcgagtgtggtaaaggctttcctgctaagattcgtctgatgggacaccagagaacccacaccggtgagaaaccctatatctgcaatgaatgcgggaaaggttttactgagaagtcacacctgaatgtgcacaggcgcacccacacgggggagaaaccttatgtctgtagtgagtgcggaaagggactcaccggcaagtctatgttgatcgcccatcagagaacacatactggcgagaagccttacatctgcaacgaatgtggaaaggggttcacaatgaagagcaccctcagcattcaccagcagacgcacaccggcgagaaaccctataagtgtaatgagtgtgacaaaacttttaggaaaaagacttgcctgatccagcaccagcgttttcacaccgggaagacctcttttgcgtgcactgagtgtggaaaatttagcctgcgaaagaatgatctgatcactcaccagagaattcacaccggggagaaaccctacaagtgttctgactgcggaaaagccttcaccacaaagagcgggttgaacgttcaccagagaaaacacactggagagaggccatatgggtgtagtgactgtggcaaggcctttgctcatctgagcatattagtcaagcaccgcaggatccaccgatag

SEQ ID NO: 25615 - DNA, 2229 bp, Artificial Sequence
  Description of Artificial Sequence: Synthetic coding sequence
atgatgcaggcacaagagagcctgactctggaggacgtggcggtggacttcacatgggaggagtggcagtttctgagccccgcacagaaagatctgtatcgggacgtcatgctggaaaactactccaacttggtcgcagtcggctatcaggcctctaaaccagacgctctgagtaaacttgaacggggagaggagacatgtactacagaggatgaaatttatagcaggatttgttcagactccgggggagcttctggcggagcttatgcagagatccgaaagatcgacgatccattgcagcaccatcttcagaaccagagcatccaaaaatcagtgaaacaatgccacgagcagaacatgttcgggaacattgtcaatcaaaacaaaggacattttctgctgaaacaggactgtgacacttttgatcttcatgaaaagccactcaagagcaacctgagctttgagaatcagaaaaggagctcaggcctgaagaatagcgcagagtttaatagggacggcaaatctctttttcacgccaaccataagcagttttataccgagatgaaatttcccgcaatagcgaagccgattaacaagtctcagtttattaaacagcagcgcactcacaatattgagaacgcgcacgtttgtagtgaatgtggaaaagctttccttaaactgtcgcagtttattgaccatcagcgggttcacacaggggaaaagccacatgtttgcagcatgtgtggaaaagcctttagtcgaaagtcacggttgatggaccaccagcggacccacactgaacttaaacactatgaatgtactgagtgtgacaagactttcttgaagaagagccagttaaatattcatcagaagacacacatgggtggcaagccatacacctgttctcaatgcggtaaagctttcataaaaaaatgtcgcctcatctaccatcaacgcacccatactggagagaaaccccacggctgctcagtatgcggcaaggcattttcaacaaagttctcactgaccacccaccagaagacgcacaccggggaaaagccatacatttgcagcgagtgcgggaagggcttcatcgaaaaacgtagactcaccgcccaccatcgcacccacaccggcgagaagccctttatctgcaacaagtgtgggaagggctttaccctaaaaaattcactcattactcaccagcagacacacacaggcgaaaagctgtatacatgcagtgagtgcggcaagggttttagcatgaaacattgtctgatggtccatcagagaactcatacgggggagaagccatataagtgcaatgaatgtggaaagggatttgctctcaaatcccctttgattagacaccagaggacccacaccggagaaaaaccctacgtgtgcactgaatgccgcaagggattcaccatgaagtccgacttgatcgttcaccagcggacgcatactgcagagaagccctatatctgcaacgactgcggaaaagggttcacggtgaaatcccgattgattgttcaccagcggacccatactggtgaaaaaccctacgtgtgtggagagtgtggtaagggctttcccgctaagattaggttgatgggacaccagagaactcacacaggggaaaaaccgtacatctgcaacgaatgcggcaagggatttactgaaaagtcacacctcaacgttcatcgcaggacccacactggggaaaagccctatgtgtgcagcgagtgtgggaaaggcttgaccggtaagtccatgctcatcgcacaccagaggacccatacaggagagaaaccgtatatatgcaacgaatgcgggaaaggcttcaccatgaaatctaccctgtccatacaccagcagacacacaccggggaaaaaccctataagtgcaatgagtgtgacaagacattcaggaaaaaaacgtgccttatacaacaccagagattccatacaggtaagacgtccttcgcttgtaccgaatgtggcaaattttcgctccggaagaatgacctgatcacgcatcaacgtatccacacaggcgagaagccttataagtgtagtgattgtggtaaagcctttaccactaaaagtgggctgaacgtgcatcagcgtaagcacacaggtgagcgcccatacggttgctctgattgcggcaaggctttcgctcacctcagcattcttgtgaagcacaggagaatccaccggtag

SEQ ID NO: 25616 - DNA, 2346 bp, Artificial Sequence
  Description of Artificial Sequence: Synthetic coding sequence
atggcgacgcaaggacacctgacctttaaggacgttgctatcgagtttagtcaggaagaatggaaatgtttagagcctgtccaaaaggcactctacaaagatgtcatgctcgaaaactatcgcaacttggtctttctgggcattagtcctaaatgcgtgataaaggagcttcctcctaccgagaatagcaataccggagaacggtttcagactgtcgccctggagcggcatcagtcctatgacatcgaaaatttgtatttccgggagatacagaaacatctccacgacctggagtttcagtggaaggacggcgaaacaaatgataaggaggtgcccgtgccacatgagaacaacctgacaggcaaaagggatcagcactctcaaggcgatgtcgagaataatcacatcgagaaccagctgactagtaatttcgagagcaggcttgcagagctgcagaaagtgcagaccgaaggaagactgtatgaatgcaacgagaccgaaaagaccgggaataatgggtgtctggtatcccctcacattcgcgaaaaaacatacgtctgtaatgaatgtggaaaagcctttaaagcttcttcttcactgattaatcatcagcgcattcatacaacagaaaaaccatacaagtgtaacgaatgtggcaaagcgttccacagggcttctctgcttaccgttcataaagtcgttcacacccggggtaaatcttatcagtgcgatgtttgtggaaaaattttcaggaaaaacagttatttcgtgcggcatcagcgctctcataccggccagaagccctatatttgcaacgaatgcggcaagtcctttagcaagtcatcccacctagcagtgcatcaacgcatccataccggggaaaaaccgtataaatgcaatctgtgcggcaaaagtttctcgcagagagttcatctgaggttgcaccagaccgtccatacaggcgaaagacctttcaaatgcaatgaatgtggcaaaacattcaagcggtcatccaatctgacagtccatcaggtaatccacgccggtaaaaaaccttataagtgtgacgtatgtgggaaggcttttcgccaccgatccaatctggtgtgtcatcgccgtattcactcaggggagaaacagtataaatgcaacgaatgcggaaaggtgttttccaagcgaagttccctggctgtccacaggcggatccatactgtcgaaaagccttgcaagtgcaatgagtgcgggaaggtgttctccaaaagatcttcccttgcagtgcaccagcgcatccacacgggccagaaaacatataaatgtaacaaatgcggaaaagtgtacagcaagcattctcacctggccgtgcactggcggatccacactggcgaaaaggcttacaagtgtaatgagtgcggcaaggtcttcagcattcactcaaggcttgcagcacaccagcggattcacactggggagaaaccctataagtgcaacgaatgcggtaaggtgtttagtcagcacagcagactggccgttcaccggcgtattcacacgggcgagaagccttataaatgtaaagagtgcggaaaggtgtttagtgacagatcagcctttgctaggcaccggcgaattcataccggcgagaaaccatacaagtgcaaggagtgtggaaaggtgttttcacagtgctctaggctcaccgtgcaccgaagaatccattcaggcgagaagccgtacaagtgcaatgagtgcggcaaggtctacagtcagtatagtcacttagtggggcaccgacgtgttcacaccggagaaaagccttacaaatgccatgaatgtgggaaggcttttaaccaaggaagcacattaaaccgccaccaacggattcacacaggagaaaaaccatacaagtgcaaccagtgtggtaattccttctcgcagagagtacatctccgcctccaccagacagttcacacaggagatcggccttataagtgcaatgagtgtggcaaaacattcaaaaggagctcaaacctgactgcacatcaaataatccacgccggaaaaaaaccttacaagtgtgacgagtgcggcaaagtatttagacactccagtcatttagtcagtcatcagaggatccacaccggcgaaaaacgctacaaatgtatcgagtgcggtaaggcattcggacgcctgtttagtctgtccaagcatcagaggattcactccggcaaaaaaccctataagtgtaatgagtgcggtaagtcctttatttgtagaagtgggctgacaaaacatagaatccggcacacgggtgagtctttgacgacaaagctgaacgtgactcggccatag

SEQ ID NO: 25617 - DNA, 2346 bp, Artificial Sequence
  Description of Artificial Sequence: Synthetic coding sequence
atggcaacacagggccatctgaccttcaaggacgtggcgatcgaattttcccaggaggagtggaaatgtctcgaaccagtgcaaaaggccctgtataaagacgttatgctggaaaactaccgtaacctggtcttcctcggtatctcccccaagtgtgtgattaaggagctacctcctacagaaaacagtaacacgggggaaaggtttcagacagtagctctggaacgtcatcagagttacgatatcgaaaatctgtatttccgggagatccagaagcacctacatgatctggaattccaatggaaggacggcgagactaatgataaggaagtaccggttccccatgagaacaacctgacaggtaagcgggaccagcatagccagggggacgtggaaaataaccatattgagaatcagctcacaagcaactttgagagtagattagcagaactccagaaggtgcagactgagggaaggctctacgagtgtaacgagaccgaaaaaacgggcaataacggttgtttggtgtcaccacatattcgggagaagacgtatgtctgcaacgagtgtggaaaagcgtttaaggcgagttctagcctgataaatcatcagaggattcacacaacagagaagccatataaatgcaacgagtgtggaaaggcttttcaccgagcaagcctgttgacggtgcacaaggttgttcacactaggggcaagagttaccagtgtgacgtgtgtggtaagatcttcaggaaaaattcctactttgttcgccaccagcggtctcataccggccagaagccttacatctgcaacgagtgtggcaaaagtttttcgaagagttcacatttggcagtacatcaaaggatccataccggcgaaaagccctataaatgtaatctgtgtggcaagagtttctctcaacgcgtccatctgcggctacatcagaccgtacacactggcgagcgaccatttaaatgcaatgagtgtgggaaaacattcaaaagaagttctaatcttaccgtgcatcaggtcatccacgctggcaagaagccatacaagtgcgacgtttgtgggaaggccttcaggcaccggagtaacctggtttgtcatcgcaggattcattccggagagaaacaatacaaatgcaacgagtgtggcaaggtgttctctaagcgttcctcactggctgtgcacagacgcattcatacagtcgaaaaaccttgcaagtgcaatgaatgtggaaaggttttcagcaagaggtcttcgctggccgtccaccagcggatccatacagggcagaaaacgtacaagtgcaacaaatgtggcaaagtgtattctaagcatagtcacttggccgttcattggagaatccacactggcgagaaagcgtacaaatgcaacgagtgcgggaaagtgttttcaatccattctcgtctagccgcacatcagcgcatacatacaggcgagaagccgtataagtgcaacgaatgtggcaaggtgttttcgcaacatagtcgcctggccgttcacagaagaattcatactggcgagaagccctataaatgtaaagaatgcgggaaagttttctcagacagaagcgcctttgccagacatcggagaattcacacaggagagaagccttataagtgcaaagaatgtggcaaggttttttcacaatgtagcaggttgaccgtccatagacgcatacacagtggagaaaagccttacaagtgtaatgagtgcggaaaagtgtacagccagtacagtcaccttgttgggcataggagggtgcatacgggcgaaaagccctataagtgtcacgagtgcggtaaggcattcaaccagggtagcacactcaatcggcaccagcgaatccacacgggagaaaagccgtacaagtgtaaccagtgcggcaatagcttctcacagagggtccatctgagactacatcagacagtccacacaggggatcgtccctacaaatgcaacgagtgcggcaagacgttcaagagatccagtaatctgactgcccatcagatcatccacgcaggcaagaaaccttacaagtgtgacgaatgcgggaaagtgttcaggcacagttcccacctggtctctcaccagaggattcacacaggggagaaacggtacaaatgcatcgaatgtggaaaggctttcgggaggctgttttcgttatccaagcaccagcgcatacatagtgggaagaaaccctataagtgtaacgagtgtggaaagagcttcatttgtcgcagcggcctgaccaagcatcgcatcagacatacgggcgagagtttaaccaccaagctcaatgtgactcgaccctag

SEQ ID NO: 25618 - DNA, 2586 bp, Artificial Sequence
  Description of Artificial Sequence: Synthetic coding sequence
atgaaccaacctgggggagccgcagcgcctcaggctgatggcgcaagcgctgccggacgaaagagcacagcctcccgagagcgattgaagaggtcgcaaaagtctaccaaagtggaaggccctgagcctgttcccgctgaggcttccctctcagcagagcagggcacaatgacagaggtaaaggtgaagaccgagctccctgacgactatattcaggaggtgatctggcagggcgaagcgaaggaggagaaaaaggccgtctccaaggacggtaccagtgatgtgccagccgagatctgcgtggttattggcggagtaagaaatcagcagacactgggctcatacgaatgcggaatttgcggaaaaaagtacaagtattacaactgcttccagactcacgtcagagctcatcgcgacacagaggccactagtggcgaaggcgcttctcaaagcaacaatttcagatacacatgcgatatttgcggcaaaaaatacaagtactattcctgttttcaggaacacagagatttgcacgccgtagatgtgttttctgtggaaggggctcctgaaaaccgggcagatccttttgaccagggcgttgttgccacagacgaagtgaaggaagaacccccagagccattccagaaaattggtcccatgaacaatatcactagcgacattttcaaaaagaaagaggttagacagtgccagaaacgtgagacaggtaactatacctgcgagttttgcggcaagcagtacaagtactacacaccctaccaggaacacgtcgccctgcatgcgcctatcaagtcagcgttcagtcggcgtgtcgagggcaaggcacaaaatcactttgaggagacaaactcttcctcccaaaacagttcagaaccttatacatgtggcgcttgtggcattcagttccagttctacaacaatctgctggaacatatgcagtcccacgcggctgacaacgagaataacattgccagcaaccaaagcaggtcacccccagcagtggtggaagagaaatggaagcctcaggctcagagaaatagcgctaacaatacaaccacctccggactgaccccaaactccatgattcctgagaaggagcgccagaatattgccgagcgactgctgcgcgtgatgtgcgctgacctgggggctctctccgttgtctctggaaaggagttccttaagctggcacagactctggtcgattccggcgcacggtatggggcatttagcgtcacggaaattcttggaaacttcaacacactggcactaaagcatctgcctcggatgtacaatcaggtcaaagtgaaagtaacatgcgccctggggtctaatgcctgcctgggaatcggagtgacctgccactcacagtcagtgggaccagattcctgttatattctaaccgcataccaggccgaagggaaccacattaaatcctatgtgctgggcgtgaagggcgcagacatcagggattccggggatttggtgcaccactgggtacaaaacgttctttccgagtttgtaatgtctgagattcgcacagtgtacgtgactgactgccgagttagcacttccgcattctccaaagctggaatgtgcctccgctgcagtgcctgtgccctgaactccgttgtgcagtctgtgctgtccaaaaggaccctacaggccaggtccatgcacgaggttattgaactcctgaatgtatgcgaggaccttgccggttctacaggtctcgccaaagaaacctttggatccctcgaagagacttctccgcctccatgctggaattcagtcaccgatagtctgctgctagtgcatgaaagatatgagcagatttgtgagttttactcccgcgcaaagaagatgaacctgatacagtctcttaataagcacctgctgagtaatctcgccgcaatcctgacccctgtgaaacaggcagtgatcgaattatcaaatgaatcccagcccacgctgcagctggtactgcctacctacgttcgactcgagaaactgtttaccgcaaaagccaacgatgccggtacggtctctaagctgtgccatctctttctcgaggctcttaaagagaactttaaagtgcaccccgcacataaagtcgccatgattctggatcctcagcaaaagctacgcccagttcctccctatcagcacgaagaaattatcggaaaggtctgcgagctgattaatgaggtaaaggagtcttgggctgaggaggcagacttcgagcctgccgctaagaagcctcgttcggcagccgttgaaaatccagcagctcaggaggacgaccggttaggaaaaaatgaggtgtacgactaccttcaagaacccctgtttcaagccacccccgacctatttcagtactggtcttgcgtgacccagaaacacaccaaactggccaaattagccttttggcttctggccgttccggctgtaggggctaggagcggctgtgtgaacatgtgcgagcaggcccttctgataaagcgccgacgactcctctctccagaggatatgaacaagttgatgttcctcaagtcaaatatgttgtag

SEQ ID NO: 25619 - DNA, 1128 bp, Artificial Sequence
  Description of Artificial Sequence: Synthetic coding sequence
atgaaccagcctggaggcgctgctgctcctcaggccgacggagccagtgccgcaggccgtaaaagcacggcctctagagagcgtctcaagaggagtcagaaaagtacaaaagtggaaggacctgaacccgtgccggctgaggcctcgctgagcgccgaacaggggacaatgacggaagtcaaggtgaaaactgagttgccggatgactatattcaggaggtaatatggcagggtgaggcgaaggaggaaaagaaggccgtgagtaaagatgggacttctgatgtcccagcagagatatgcgtggtgatcgggggtgtgaggaaccagcagacactgggttcatacgaatgtggaatctgcggaaaaaagtacaaatattacaattgtttccagactcacgtgagagcgcaccgagacaccgaggccaccagtggcgaaggcgcaagccaaagcaacaatttccgctacacgtgcgatatctgcggcaagaagtataaatactattcttgttttcaggagcatagagacctacatgcggtggatgtgttctcggtggagggcgcacctgagaatagggctgacccgttcgatcagggtgtggttgccaccgacgaagttaaagaggagcctcctgaacctttccagaagatcggacccatgaacaacattaccagcgacatatttaagaaaaaagaggtccgacagtgccagaagcgagagacgggaaactatacatgcgaattctgtggcaagcagtacaagtactacactccttaccaggaacatgttgccttgcacgctcctatcagcacagcacctggctgggaaccaccagacgatccagatacaggcagtgaatgttcgcatcccgaggtgtcccctagcccaagatttgtagccgcaaaaacccagactaatcagtccggcaagaaggccccagcctcagttgtccggtgcgccacactcctccaccggacaccaccagctacccaaacccagacttttcgaacacccaactccggctccccggcttcaaaggcaacggccgagtccgcattctcccgcagagttgagggcaaggcccaaaaccatttcgaagagacaaactctagcagccagaacagctag

SEQ ID NO: 25620 - DNA, 2865 bp, Artificial Sequence
  Description of Artificial Sequence: Synthetic coding sequence
atgaaccagccaggaggggcagctgctccacaggctgacggtgctagtgcagcaggaagaaagtctacagcctccagagagagactaaagaggtcccagaagtcaactaaagtggaaggtccagaaccagtaccggctgaggcctctctgagtgcggaacaagggaccatgacagaggtgaaagtgaagacggaattgccagatgattatatccaggaggtgatatggcagggtgaagcaaaagaggaaaagaaggcagtgagcaaggacggaaccagcgacgttcccgctgagatctgtgttgttataggcggagttagaaaccaacaaactctggacgggaaggccccagagggatcccctcatggcggatccgtcaggagtagatatagcggaacatggatcttcgaccaggctctgcgatacgcgagcggaagttacgagtgtgggatctgtggtaaaaaatataagtactacaattgctttcagacccatgtacgggcacacagggacaccgaagctacttccggggaaggcgcttcacaaagcaataatttcaggtacacctgcgacatttgcggaaaaaagtacaaatattactcctgcttccaggagcaccgcgacttacacgcagttgacgtctttagcgtggagggggcaccagaaaatcgcgctgatccctttgaccagggggtcgttgccacagatgaggtgaaagaggagccacccgagcccttccagaaaattggacccaaaaccggtaattacacatgcgaattttgcggcaaacagtataagtactatacaccctatcaggaacatgttgccctgcacgccccaatcagcacagcccctggttgggagcctcccgacgaccccgacacaggaagtgagtgttctcatccagaggtgagcccatccccccgttttgtggccgcaaagacccagacaaaccaaagcgggaagaaggccccagccagtgtagttcgctgtgcgacactgctacatcggacgcctcccgctacacagacacagaccttccgtacacctaacagtggatcccctgcttcgaaggccaccgcggctgaatcagcgttctcaaggcgggttgaaggtaaggcacaaaatcattttgaggaaactaatagcagcagccagaactctagtgagccctacacttgcggggcatgcgggatccagtttcagttctacaataacctgctggagcatatgcaaagccatgcagctgacaacgaaaacaacatcgcctccaaccagtctagatcgcctcccgctgtggtggaagaaaaatggaaaccccaggcacagagaaactctgcgaacaacactaccacttccggactcacccccaacagcatgatacccgaaaaggagaggcaaaacatagcagagcgcctgctgcgggtcatgtgcgcagaccttggtgcgctctccgtggtgagcggcaaggagtttctaaagttggcccagactctggtggattcaggagcaaggtacggagcgtttagcgtgactgaaatactcggcaacttcaatacactggcacttaaacatctgccacgtatgtacaaccaggttaaagtcaaggtgacttgtgccctaggttcgaacgcatgtcttggaattggtgtgacctgtcatagtcaaagcgttggacccgattcctgctatattcttacagcctaccaggctgaaggaaaccatatcaagagctacgtgctcggcgtgaagggagcagacattcgtgacagcggggatttggtacaccactgggttcagaacgttttgagtgaattcgtaatgtccgagattaggactgtgtatgttaccgactgtcgagtatcgacaagcgctttcagcaaagccggtatgtgtttacgctgcagcgcatgcgccctcaactcggtagtacagtccgtgttatctaaacgcacccttcaggctaggagtatgcacgaagtgatcgagttgctgaacgtgtgcgaggatcttgctgggtcgaccggactggctaaggagaccttcggtagtttagaggaaacgagtcctcctccctgttggaacagtgttaccgactcactcttgttagtacacgagcgatatgagcagatctgtgagttttacagccgcgctaagaaaatgaacctcatccagtcactcaataagcacctgctgtctaatctggccgcaatccttacacccgtgaaacaggcagttatagaactgagtaatgagagccaacccaccctccagctagtgctacctacgtatgtgcgactggaaaagctgttcaccgctaaggctaacgacgccggtaccgtgtccaaactctgccacttattcctggaagcactgaaggaaaacttcaaggtgcatccagctcataaggtggccatgatcctggatccccagcaaaagttgcgccctgttccgccataccagcacgaagagattatcggcaaggtttgcgagcttattaatgaggtgaaggaaagctgggctgaagaagcggatttcgagccagcagcgaagaagcctaggagcgccgcagtggaaaacccagctgcacaggaagatgaccgcctcggcaaaaacgaggtgtatgattatttacaggaacccttatttcaggctacccctgacctctttcagtattggagttgcgtgacccagaaacacaccaagttggcgaagctggctttctggcttctggctgtgccagcagtgggcgcaagatcaggctgcgttaatatgtgcgagcaggcgctcttgattaagcggaggagacttctttcaccagaagacatgaataagctcatgtttcttaagagtaacatgctgtag

SEQ ID NO: 25621 - DNA, 915 bp, Artificial Sequence
  Description of Artificial Sequence: Synthetic coding sequence
atgaaccagcctgggggagcagctgcgccacaggccgacggggcatcagcagctggcaggaagagcaccgcttctcgcgaacggctcaaacgctcacagaaatcaactaaagttgagggaccggagccagtgcctgccgaggcatccttgtctgcagagcagggaacaatgacagaggtcaaggtgaagactgagttacccgatgattacatccaagaggtcatctggcagggcgaagccaaggaggagaagaaggccgtcagtaaggacggcacatcagatgtgccagccgaaatctgcgttgtgatcggcggtgtgcggaatcaacagactctcggtagttacgagtgcggaatttgcggcaaaaagtataagtattacaattgttttcagacacacgtgcgagctcacagagacaccgaagcaacgtccggcgagggggcatcccagagtaacaacttcaggtacacatgtgacatctgcggaaagaagtataaatattacagctgcttccaggaacatcgcgatctccacgctgttgatgaccctttcgatcagggcgtggttgcaaccgacgaggtgaaggaggagccccctgagcccttccagaagataggtccaatgaacaacatcaccagcgatatcttcaaaaagaaggaagtgagacagtgccaaaaacgcgagacaggcaactatacctgcgaattttgcggaaaacagtataaatattatacgccttaccaagagcatgtcgccttacacgcccctattacaactcagactcagactttcagaactcctaacagtgggtcgccagcatctaaagcaacagctgagagcgcattttccagaagggtggagggcaaagctcagaatcacttcgaagagacgaactctagctctcagaattcgtag

SEQ ID NO: 25622 - DNA, 1683 bp, Artificial Sequence
  Description of Artificial Sequence: Synthetic coding sequence
atgggacagccggctccatacgccgagggtcccatccagggcggagacgctggagagctgtgcaaatgcgacttccttgtcagcattagcataccccaaacccgctctgacattcccgcaggagcacgacgttcttctatgggccctcgcagtttagacacatgctgggggaggggcccagagagacacgtgcacaggcttgagtgtaatggcgtcattttcacccaccgtaatctctgcctccctggcggaaaaactaagactgagaatgaagagaagactgctcagttgaacatttcaaaggagtcggaatctcacagactcatcgttgagggcctgctcatggacgtcccccaacacccagatttcaaggataggctcgagaaatcccagttgcacgatacagggaataagaccaagattggtgactgcacagacttaaccgtacaggaccatgaatcaagtaccacagagcgtgaggaaatcgctaggaagctggaggagtctagcgtctccactcacctgatcacgaagcaggggttcgctaaagagcaggtattttacaagtgtggtgaatgcggctcctactataacccacatagcgacttccatctccatcagcgcgtacatacgaatgaaaagccatatacctgtaaggaatgtggaaaaaccttccgatacaacagtaagctatcgaggcaccaaaagatccatacaggagagaaaccctactcctgtgaagaatgcggtcaagcattctcccaaaattcccatcttcttcaacatcaaaaactgcacgggggtcagagaccctatgagtgcaccgactgcggtaagacattcagctacaactccaagctgatccgacatcagagaatccataccggtgagaaacctttcaaatgcaaggaatgcggcaaggcgtttagctgtagctatgactgtatcatccacgagagaatccataacggcgagaaaccctatgaatgcaaagagtgcggaaaatcactctcttccaatagtgttttgatccagcaccaacgtattcatacaggcgaaaaaccgtatgaatgcaaggagtgcggaaaggcctttcataggtctagtgtgtttctccagcatcagaggttccacacaggggagcagctctacaaatgcaacgagtgctggaagacctttagctgctctagcaggttcatagtccaccaacgcatccacaatggcgaaaaaccctatgagtgccaggagtgtggaaaaactttctcgcagaagataaccctcgtgcagcaccagcgggttcacactggcgagaagccgtatgagtgtaaagagtgtggcaaggcctttcgttggaatgctagttttatacagcaccaaaaatggcatacaagaaagaagctcattaacggaactgggctctctgccgtgaagccgtactgtccatgcgcaatcttgtcacctctgccaccacagcacacatgttcagcacttgctccaccaggaccaccgctgtcctcttcacacgccgttgtcctcccaccgtcggtgccgtttttcctcttgttacccagcagtgaaaaagccaacccttctcctgtgcagatagcccatttcttccaagatttggccttcccaggcaaatccagtctccagagcccaaaccccctgtctcacagcctctag

SEQ ID NO: 25623 - DNA, 1731 bp, Artificial Sequence
  Description of Artificial Sequence: Synthetic coding sequence
atgctccagaccgtgtggttccaaggccttggccgaaatctactgttccaggaacctgtgactttcgaagatgtagctgtgtattttacacagaatgaatgggcaagtctgcatcctacgcaacgagcactgtaccgagaagttatgctcgaaaactacgcaaatgtcacttcactttcggcatttccttttcccaaacctgacctcattttccagctcgagcaaggggaggccgcttgggggcctgatccatggacactggcgggaggcgaagctctccggggtatgtgcaccggcggaaagacgaagacagagaacgaggaaaagaccgctcagttgaacatctcaaaggagtcagagtcccaccgcctaatcgtggaaggcctgctgatggatgtcccccaacaccctgatttcaaggaccgcctagagaagagtcagctccacgacacaggaaacaagaccaagatcggcgactgtacagacctgacagtccaggaccatgagtcatccacaacggagcgcgaggagatcgcacgaaaactggaggagagctccgtgtccacacacttgattactaagcagggcttcgctaaagagcaagtgttttacaagtgtggcgaatgtggctcctactacaaccctcattccgattttcacctgcatcaacgcgttcataccaacgagaaaccctatacatgcaaggaatgtggaaaaacttttcgctacaactctaaactgagtcggcatcagaagatccacacaggtgaaaagccttactcctgcgaagagtgcggacaagctttctcacagaattcacatctgcttcagcatcagaaattgcatgggggacagcgcccttacgagtgtacggactgtggtaagactttttcctacaatagcaagctaatccgtcaccagagaatccatacgggcgagaaacctttcaagtgcaaggagtgtggcaaagcgtttagttgttcgtacgactgcataattcatgagagaatacataacggagagaagccttatgagtgcaaggaatgtggaaagtccctatcctcaaattctgtcttgattcagcaccagcgtatccacaccggcgagaaaccatatgagtgcaaggaatgcggtaaggcctttcatagaagctccgtgtttctgcagcaccaacgctttcacaccggcgagcaactgtacaaatgtaatgagtgctggaagactttttcgtgtagctcccgatttatagtgcaccagcgcattcacaacggtgagaagccttatgaatgtcaggagtgcgggaagacttttagccagaagatcaccctggtccagcaccaaagggtacataccggggagaagccatatgaatgtaaagaatgtggcaaggcctttcgctggaacgcgtcctttattcagcaccagaagtggcatacgcgtaagaagttgatcaacggcacagggctgagtgcagtgaaaccttactgcccatgtgctatattgtcccctcttcccccacagcatacatgtagcgctcttgctcccccaggccctccgctatcatccagccacgctgtggtgctgccacccagtgtgccattcttcttactgctgccttcttccgaaaaggcaaacccatctcctgtgcagatcgcacacttttttcaggatttggcctttcctggaaaatccagcctgcagagtcctaaccccctgtcccactctttatag

SEQ ID NO: 25624 - DNA, 1731 bp, Artificial Sequence
  Description of Artificial Sequence: Synthetic coding sequence
atgcttcagacagtctggttccagggactgggccgaaacctcctctttcaggagccggtcacttttgaggatgtggccgtgtattttactcaaaacgaatgggccagcttacatcccactcaaagggccctttatagggaggtgatgctggagaattacgccaatgtcacatcgttgagtgcattcccattcccgaaacccgatctcattttccaactggagcagggtgaggccgcttggggacccgacccttggactcttgccggtggtgaggcactaagaggcatgtgcaccgggggaaagacgaaaacagagaatgaggagaaaactgcacagcttaatatttctaaagagagcgagtctcatcgattaatcgtcgaaggcttgctcatggacgtcccacagcacccagatttcaaggacagactcgagaaatctcagctgcacgatactggcaataagacgaagataggagactgcaccgatctgacggttcaggaccatgagagctctaccacagaacgtgaagagatcgctcggaagctggaggagtcgtcagtcagcacccacctgatcactaaacaggggtttgccaaagaacaagtgttctataaatgcggcgagtgcgggtcttattataaccctcactctgacttccatctccaccagcgggtccacaccaatgaaaagccttatacttgcaaagagtgcggaaagacgtttcgttacaattccaaactgtcccggcatcagaagatccataccggtgagaagccatactcctgcgaagaatgcggccaggctttctcgcagaatagccacctgttgcagcatcagaagctgcatggcggacagcgcccatacgagtgcaccgactgtggaaaaactttctcctacaacagcaagctgatccggcaccaacggatccacaccggtgagaagcccttcaagtgtaaggaatgtggcaaggcgttctcatgcagctatgattgtatcatacatgagaggattcataatggtgagaagccctatgaatgcaaagagtgcggtaagagcctgagctctaatagcgtgctgattcagcaccagcggattcatactggcgagaaaccctatgagtgcaaggaatgcgggaaagcctttcatcgatccagcgtgttcttgcagcaccagcgatttcatacgggcgaacagctctataaatgcaatgaatgctggaagaccttttcctgctccagtcggtttattgttcatcaacggattcataatggggaaaaaccatatgagtgccaggaatgcggtaagacgttctcgcagaaaataactttggtccagcaccagagagtccacaccggcgagaagccctacgagtgcaaagagtgcggtaaggccttcagatggaacgctagcttcattcagcaccagaaatggcacacacgcaaaaagctgatcaacggaactggcctatcagcagtcaagccgtattgtccctgcgccatattgtctccactcccccctcagcacacatgctctgccctcgcgccacctggaccgccactctcctccagccacgcggtggtgttaccgccatctgttcctttttttctgcttttgcccagctctgaaaaagcgaatcccagtcccgtgcagattgctcatttcttccaggatctagctttccccggaaagagcagccttcagagtcccaaccccctgagccattccctctag

SEQ ID NO: 25625 - DNA, 594 bp, Artificial Sequence
  Description of Artificial Sequence: Synthetic coding sequence
atggggcaacccgctccctatgccgaaggaccgattcaaggcggagatgctggagagctgtgtaagtgtaatgagtgctggaagactttttcatgcagctctaggtttatcgtccaccagaggattcacaacggcgagaagccgtatgagtgtcaggaatgcgggaaaacatttagtcagaagattacccttgtgcaacaccagagggtgcataccggagaaaaaccctatgagtgcaaagagtgtgggaaggcattcagatggaatgcgtcatttatccagcaccagaaatggcacaccagaaaaaaactgattaatggaacagggttaagcgctgtaaaaccttattgcccatgcgcaatcctgtctccacttccccctcagcacacttgttccgccctcgcgccaccaggtccccctctgagcagcagtcatgcagtcgtgctgcccccatcggtaccgtttttcctcctgttgccgtcgtccgaaaaagctaacccctcccccgttcagatagcgcatttttttcaagacctcgcattccctgggaaatctagcttacagtcccctaatccgctcagtcactcactgtag

SEQ ID NO: 25626 - DNA, 1851 bp, Artificial Sequence
  Description of Artificial Sequence: Synthetic coding sequence
atgctccagaccgtgtggtttcaggggttagggagaaaccttctcttccaggaacccgtgacatttgaagatgttgccgtgtacttcacccagaacgaatgggcttccctgcacccaactcaacgagctctttaccgagaagtcatgttggagaactatgctaatgtgacatccctgtaccccactgcgggaggcttccccctggacactgagagaacagaaaaagtgcctggtgcactttcttccttcctaccttcctcctcaagccttgaattgatcctggcgctgctgccaatgagcgcttttccctttccgaagcccgacttgatctttcagctggaacaaggggaggctgcctggggcccagacccctggaccctggcgggaggggaggccctacggggtatgtgtacagggggaaaaacaaaaacagagaatgaagaaaaaacagctcagctcaatattagcaaagaatcagagagccaccggttgatcgtggagggactcctgatggacgttccgcagcacccagattttaaggaccggttggaaaaatcacagctgcatgatacaggcaacaagactaaaattggcgactgtactgatctgaccgtgcaggatcacgagtcatctaccaccgaaagggaagagatcgcacggaaactggaggaaagttcagtcagtacgcatcttatcacgaagcaagggtttgcaaaggagcaagtattttataaatgcggcgagtgtggatcgtactataatcctcacagtgatttccacctgcatcagagagtccacacaaacgaaaaaccttatacctgcaaggaatgtggcaagacatttcggtacaacagcaaactctctcgtcaccagaaaatccacacaggagagaagccttactcctgcgaggaatgtggacaggcctttagtcagaattcccacctgctccagcatcagaagttgcacggaggtcagaggccatacgagtgtacggactgtggtaagacgttttcttacaacagtaaactgatccgacatcagcgaattcatacgggggaaaaaccatttaagtgtaaagagtgcgggaaagcatttagctgtagttatgattgcatcatccacgagcgtattcataacggggagaaaccttacgaatgcaaggaatgtggaaaatctttgtcctccaactcagtcttaattcagcaccagcgtatccatactggggaaaagccatatgaatgtaaggagtgcgggaaagccttccatcggagttctgtgttcctgcagcaccagagatttcatactggcgagcagctctacaaatgtaatgagtgctggaaaacattcagctgtagttcccgatttatagtgcaccagagaatacacaatggagagaagccatacgagtgtcaagagtgtggaaaaacattctcgcaaaaaattacactggtgcagcaccaacgcgtgcataccggagagaagccctatgaatgcaaggagtgcggtaaagcatttcgctggaatgcctcttttatacagcaccagaaatggcacaccagaaagaagctcatcaacggtaccggactgtcagccgtgaagccttattgcccctgcgccatacttagcccactgcccccacagcatacttgcagcgcgctggctcctccagggccacctcttagttcaagccatgcagtcgtgctacctccatccgttccattcttcttgctgctaccatcatcagagaaagcgaacccttcacctgtgcagatcgcgcactttttccaggacttggcttttccaggcaaatctagccttcagagtcccaacccgctctcgcacagcttgtag

SEQ ID NO: 25627 - DNA, 1599 bp, Artificial Sequence
  Description of Artificial Sequence: Synthetic coding sequence
atgaagcccggtgtgatatcgcatgcgcctgactccgtggtccctgcagcatttcccttccctaagcccgacctcatatttcagctggaacagggagaggcggcttgggggccagacccatggacactcgctgggggagaggcgttgcgcggaatgtgtaccgggggaaagactaagacagaaaatgaagaaaaaactgcgcagctcaatatctccaaagagagcgaatcccaccggcttatcgtggaaggattgctgatggatgtaccccaacaccccgattttaaagaccgactagagaaaagccagttgcacgacaccggtaataaaactaaaattggagattgcacagacctaactgtgcaagatcacgagtcttccacaactgaaagggaagagatcgcccgaaaactggaggagtcttctgtgtctacgcacctcatcaccaagcaggggtttgcaaaggagcaagtgttctacaagtgtggagagtgcggaagctattataaccctcactccgacttccaccttcaccagagagtccacactaacgaaaagccttacacatgcaaggagtgcggaaagacttttaggtataacagtaagctgtcgcgtcaccagaaaattcacaccggcgaaaaaccatattcatgcgaggaatgcgggcaggctttcagccagaattctcatctcctgcagcaccagaaattacacggaggccaacggccttatgagtgcaccgattgtgggaaaacctttagctacaactccaagcttattcggcaccagcgcatccacacaggtgaaaagcccttcaaatgtaaagagtgcggtaaagcgtttagctgctcctacgattgcatcatacacgaaaggatccacaacggggagaaaccctatgaatgcaaagagtgcggcaaaagcctcagctccaacagcgtacttattcagcatcagcgaattcacacaggcgaaaagccgtatgaatgcaaggaatgtggcaaggctttccatagatcctctgttttcctgcaacatcagaggtttcatacaggagagcagctgtacaaatgcaacgagtgctggaaaactttcagttgcagctcaaggtttattgtgcaccagcggattcataacggagaaaagccttacgagtgccaggagtgcggcaagacgttttcgcaaaagattaccctggtacaacaccagcgggttcacacaggggaaaagccctatgaatgcaaagaatgtggtaaggcgtttcgctggaatgcgagcttcatccagcatcagaaatggcacacaaggaagaagctcataaacgggactggactgtcggccgtcaagccctattgtccctgtgctatcctgtcccccctgcctccccaacacacgtgctcagcactggcccctcctgggcctccattgagctcatctcacgccgtcgtgctgcctccaagtgtgccgttctttctcctcctgccaagctccgagaaggcgaatcccagtccagtccagatagcacacttctttcaggatctggcttttcccggaaaatcctctttgcagagtccaaatcccttgagccactccctatag

SEQ ID NO: 25628 - DNA, 1851 bp, Artificial Sequence
  Description of Artificial Sequence: Synthetic coding sequence
atgctgcagaccgtctggttccaggggctggggagaaatctgctgtttcaagaacccgtgactttcgaagatgtcgcagtctatttcacccagaacgagtgggcgtcactacatccaacacagcgagctttataccgggaagtgatgttggaaaactacgctaacgttacaagtctatatccaaccgccggtggctttcctctcgacactgagcgcaccgagaaggtaccaggagctttgagctcgttcttgccttctagctcatccctggaactgattctggcactgttacccatgtcagctttccctttccccaagcctgatttaatcttccagctagagcagggagaggcagcatggggaccagatccatggacccttgcagggggtgaggcgcttcgaggcatgtgcaccgggggaaagacaaagacagagaacgaggagaagacagcacagctgaatatctctaaggaatcagagagccacagactgatcgtggaaggccttctcatggacgtccctcagcaccccgactttaaagaccgcttggagaagtctcagctgcatgacacaggaaacaaaaccaagatcggagattgcactgacttgacagttcaggaccacgaaagttccaccacagagagagaggaaatagccaggaagctggaggaatcttctgtcagcacccacttaatcactaagcagggcttcgcaaaagagcaggtgttctacaagtgcggtgagtgtggcagttactataaccctcatagcgattttcacctgcatcaaagggtgcatactaacgagaagccctacacttgcaaggagtgcgggaagacatttagatacaatagcaaactttcacgtcaccagaagatccacaccggtgaaaaaccgtacagctgcgaggagtgcggccaagcattttctcagaatagccatctcttgcaacatcagaaactacatggaggacaacggccatatgaatgtaccgattgtggcaaaacttttagttataattccaaactcatccgtcatcagcgaatacataccggcgaaaaaccctttaaatgcaaggagtgtggtaaagcctttagttgttcttacgactgcatcattcacgagaggattcataatggcgagaagccgtacgaatgtaaagagtgcggcaagagtttgtcctcaaattcagtgctcattcagcaccagagaatccacacaggcgagaaaccatatgagtgcaaggagtgcggaaaagcttttcataggagctcggtgttcttgcagcatcagcgtttccacacaggagaacagctctacaaatgtaacgaatgctggaagacattcagctgcagctcacgatttattgtgcatcagcgcattcataacggagaaaagccttatgagtgccaggagtgtggtaagacattcagccagaaaattactctcgtccaacaccagcgcgtccacactggggaaaagccttatgaatgtaaggagtgtggaaaagccttccgctggaatgcgtcattcatccaacaccagaagtggcatactcggaagaagttaatcaacggaacggggttgtccgccgtgaaaccatattgtccttgcgcaatattgtctccccttccaccccagcatacatgcagtgcactggcccctcctggccctcctctgtcttcatctcacgccgttgtgcttcctccctctgtgcccttctttctgctcctacccagcagcgaaaaggctaacccctcacccgtgcagattgcacacttctttcaggacctggcctttccagggaagtcttccttgcagagtccaaacccgctcagccacagtctctag

SEQ ID NO: 25629 - DNA, 1704 bp, Artificial Sequence
  Description of Artificial Sequence: Synthetic coding sequence
atgggtcagcccgctccttacgccgaaggaccaatccaaggtggcgacgcaggtgaattgtgcaaatgtgacttcttagtgtccatcagcatccctcaaacccggagtgatatccccgcaggtgctcgtcgtagtagcatgggcccacgatcccttgatacatgttgggggaggggccctgagcggcatgttcatcgagtttccctgctccttccaagactggagtgcaacggagtaattttcacccaccggaatctctgcttgcccggtggaaagacaaaaacggaaaatgaagaaaagaccgctcagctgaatataagtaaggagtccgaatctcatcgtctaatagtcgaaggactcttaatggacgtgcctcagcacccggatttcaaagataggctggaaaagagccagctccatgatactggaaataaaactaaaatcggagactgcacagacctaacagttcaggatcatgaatcaagcactacagagcgagaggagatcgcacggaaactcgaggagtccagcgtcagtactcatctcatcacaaaacagggtttcgccaaggagcaggtattctacaaatgcggagaatgcgggtcctactataatccacattcggactttcacctgcatcaaagagttcacaccaatgagaaaccctatacatgtaaagagtgcgggaaaacttttagatataactctaagctctcgcgccaccaaaagattcataccggtgaaaaaccatactcatgcgaggagtgcggccaagcattttctcagaactcccatctcctgcagcaccaaaaactacatggcggacagcggccatatgaatgcactgattgcgggaagactttttcttataactcaaaactcatccgtcaccaacgcatccacacaggggagaagccgttcaaatgtaaagaatgcggcaaggctttctcatgcagttacgactgcatcatccatgaaaggatccataatggtgaaaaaccttacgagtgcaaggagtgtggcaaaagtctgtcctccaattctgtgctaattcagcatcagagaattcatacaggggagaagccatatgagtgtaaagaatgcggtaaagcgttccaccgctcaagtgttttcctgcaacaccagcgctttcacactggtgagcagctctacaagtgtaacgaatgctggaagacattctcttgcagttctcgctttattgtacaccagaggattcacaatggagagaaaccttatgagtgtcaggaatgtggtaaaacattctcacagaagatcacacttgtgcaacaccagagagtccataccggcgaaaaaccttatgaatgtaaagaatgtggtaaagcatttagatggaatgcatcattcatccagcatcagaaatggcacactcgcaaaaagctcatcaatgggactgggctgagtgcagtgaagccttattgtccctgtgcaatcctgagcccactccctccccagcatacctgtagcgcattggctccccctggccctccgttaagctccagccacgctgtagtacttcccccttccgtgcccttttttctcctcctgcctagttctgaaaaggcgaacccttctcctgtgcagattgcacactttttccaggatctggcttttccaggaaagtcttcactccagtctcctaaccccttgtcccactcactctag

SEQ ID NO: 25630 - DNA, 474 bp, Artificial Sequence
  Description of Artificial Sequence: Synthetic coding sequence
atgctgcagacaacatggcctcaagaatccgttacctttgaagacgtagcagtgtatttcacacagaatcaatgggcttccctagaccctgcgcaacgtgcgctttatggtgaggttatgctggagaactatgcaaacgtggcgtcccttgttgcctttccattcccaaagcccgctctcatctcccatcttgagcgtggcgaggccccatggggaccagacccgtgggacaccgagattctccgagggatatcccaaggaggcgagtcatggattaagaatgaaggcctggtgatcaagcaggaagcctccgaggagaccgaactgcatcgcatgccggtcggcggtttactcagaaacgtctcccagcactttgactttaaacgaaaagccctgaaacaaacattcaatctgaatcctaacctgatcctgagagggggaagcgtggaagttcggagcttacgcccagcctag

SEQ ID NO: 25631 - DNA, 1320 bp, Artificial Sequence
  Description of Artificial Sequence: Synthetic coding sequence
atgcttcagacaacctggccccaggaatccgttacctttgaagatgtcgcagtatattttactcagaaccagtgggcgtctctggatcctgcacagcgcgcactgtacggggaagtgatgctcgaaaactatgccaacgtggcgagccttgtggcatttccttttcccaagccggctctcatttcacacctggagaggggcgaagccccatggggccctgacccgtgggacacagagatcctgagaggcatttctcagggcggtgaaagttggattaagaatgaaggcctggtgattaaacaggaagcatctgaggagaccgaattacacagaatgccagtgggcggactactcagaaatgtatcacagcactttgattttaaacgcaaagctttgaagcagaccttcaatctgaaccccaatcttattctgcgaggtgggatgaaattctacgagtgtaaagaatgcgggaaaattttcagatacaatagcaagttgatacggcaccagatgtcgcatactggtgagaagcctttcaaatgcaaagagtgcggaaaggcctttaagtcttcctatgattgcatcgtgcacgaaaagaatcacatcggtgaaggcccatacgaatgcaaagaatgcgggaagggcctgagcagcaacaccgcgcttacacagcatcagcgaattcacaccggagaaaagccctatgagtgcaaagaatgcggcaaagctttccggcgttccgccgcttatctgcaacatcagcgattacacacaggggagaaactgtataaatgcaaagagtgctggaaagcattcggttgccgcagcctgtttattgtgcatcagcgtatccacaccggggagaaaccttatcaatgcaaggagtgcggtaaggctttcacccagaaaatcgcttctatacagcaccagcgggtacacaccggtgagaagccttatgagtgtaaagtatgcggcaaagcttttaagtggtacggaagttttgtgcagcatcaaaagttgcaccccgtcgaaaaaaagcctgtgaaagtgctaggtccatcattggtgtctcctcaatgctcatctccagctattccccctgtgcttctgcaaggcagctgcagcgcctcagcggtggcagtcccttccttaacctttcctcacgctgtccttattcccacatctggtaacttctttatgcttcttcctaccagcggaatcccctctagtagtgcgcaaattgtccgggtgtttcagggcctgacccccaccgtgaaaccctcacccgtcatattgactccttcttcccactctagctag

SEQ ID NO: 25632 - DNA, 1320 bp, Artificial Sequence
  Description of Artificial Sequence: Synthetic coding sequence
atgctgcagactacttggccccaggaatccgttacttttgaggacgtggcagtgtattttacacagaatcagtgggcaagcctggaccccgcacagagggccctgtatggggaggtgatgttggagaactatgctaatgtggcatcactggtcgcgttcccctttccaaagcctgctttgatctctcacctggagcgcggagaagccccatgggggcctgacccatgggatacagaaatcttaaggggtatcagtcagggaggagagtcgtggatcaagaatgagggtctggtaatcaaacaggaggcttcagaagaaaccgagctccatagaatgcccgtagggggtctgctgcgaaatgtctcccagcactttgactttaaacggaaagctctaaaacaaacattcaacctcaatcccaatctgatcctaagggggggtatgaagttttatgaatgcaaggaatgcggtaaaatcttccgctataactccaagctcattcggcaccagatgtcccacaccggcgagaaaccgttcaaatgtaaggagtgcggcaaggccttcaaatcaagctacgactgcatagtgcacgaaaagaatcacattggagaagggccttatgagtgcaaggagtgcgggaaaggactcagcagtaacaccgccctgacgcagcaccaaaggattcacacgggcgaaaaaccatacgagtgtaaagaatgcgggaaggccttcaggaggagcgctgcgtacctgcagcatcagcggctgcacaccggcgagaagctgtataaatgcaaagagtgttggaaggcatttgggtgtcggtcattgttcatcgtgcatcagcggatccacaccggcgaaaagccatatcagtgtaaagagtgcgggaaggctttcacacagaaaatcgccagtattcagcatcagagggtgcacactggcgagaagccttacgaatgcaaggtatgcggaaaagccttcaaatggtatggctcctttgtgcagcaccagaaattgcaccccgttgagaagaaaccagtgaaagtcttggggccatcccttgtatcccctcaatgtagctctcctgccatcccaccggttctgctccagggaagttgctctgcctctgccgtagccgtgcccagcctgacattccctcacgccgtgctcatccccactagcggcaattttttcatgctattacccacatccggaatcccgagctccagcgcccagattgtccgcgtatttcaggggcttactcctaccgtgaaaccatcccctgtgatattaacccccagctcccactcaagctag

SEQ ID NO: 25633 - DNA, 459 bp, Artificial Sequence
  Description of Artificial Sequence: Synthetic coding sequence
atgctgcagacaacatggcctcaggagagtgttacatttgaggacgtggcggtgtatttcactcagaatcaatgggcctcattagacccagctcagcgcgcactctacggggaagtgatgctcgaaaattacgctaatgtggcctcacttgtggcatttccattccctaaacctgcacttatctctcatctggagcgcggagaagcaccctggggaccagacccctgggacacagagatcctccgagggatatctcaaggtggggaatcttggatcaaaaatgaaggcctggtgattaagcaggaggcaagcgaagagacagagctgcacagaatgcccgtaggaggactgcttcgaaacgtcagccaacactttgacttcaagagaaaagcactgaaacagacttttaatctgaaccccaatctgatcttgcgaggcggaatgaagttctacgaatag

SEQ ID NO: 25634 - DNA, 1425 bp, Artificial Sequence
  Description of Artificial Sequence: Synthetic coding sequence
atggagctaccatctcccgaatctgaggaagttcacgaaccgaggttgggggaattgctgggcaatcccgaaggccaatcactcggttccagtcctagtcaggaccgcggttgcaagcaggtgacggtcactcattggaagatccagaccggagagaccgcccaggtgtgtactaaaagtggaagaaaccacattctcaatagcgacctgcttctgcttcagagggagctcatcgaaggagaggcgaatccatgtaacatctgcgggaagaccttcacattcaactctgacctggtaaggcatcgaatttcccacgctggtgaaaaaccttacacctgtgaccagtgtggcaagggcttcggacagtccagtcacttaatggaacatcaaagaatacatactggtgaacgcctgtacgtgtgtaatgtttgcggcaaggatttcatccactacagtggactgatcgagcatcagagggtccattctggggagaaacctttcaagtgcgcccagtgcggaaaagccttctgtcacagcagtgacctcatcagacatcaaagagtacacacccgtgaacggccattcgagtgtaaggaatgtggtaaaggcttctctcagtcgtcacttctcatacgacaccagcggattcacacaggagaaagaccctatgagtgtaacgagtgtgggaagtcattcattcggtcaagtagtctgatccgccactaccagatccataccgaggtgaagcagtatgaatgcaaggagtgtggaaaggcttttcgtcatcggtcggatctgatagaacatcagcgcattcacacgggcgagagaccattcgaatgtaacgaatgtggaaaagccttcattaggagcagcaagcttatccagcatcaacgaatccataccggagaacggccatacgtgtgtaatgagtgtggcaagagattcagtcagacttccaacttcacccagcatcagcgaatccacaccggagaaaaattatacgagtgtaatgagtgtggcaaggctttctttctctcttcgtatctcattcggcaccagaagattcacaccggggagagagtatacgaatgcaaggagtgtggtaaggcgttcctgcagaaagctcacctgacagagcaccagaagattcacagcggagataggccctttgagtgtaaagattgcgggaaggcctttattcagagttcgaaactgttattgcaccagataatccatacaggggaaaagccctatgtgtgcagctactgtggaaaagctctctttagaggacagacaagcttcaacacccggaagttcattctaaaacgctcctctatgaacgttgtctccatgggggagattctgactcagttgcagactctcaaaataatcaaaggtttcacaaagcgcgacagcccctag

SEQ ID NO: 25635 - DNA, 1491 bp, Artificial Sequence
  Description of Artificial Sequence: Synthetic coding sequence
atggagctcccctctccggaatccgaggaggtccacgagcctaggcttggagaactgttgggcaatccggagggacaaagtcttggttcatccccctcccaggatagaggctgcaagcaggtgactgtaacacactggaagatccagacaggcgagactgcccaggtgtgcactaaaagtggtcgtaaccacatcctcaatagtgacctgctactgctccagcgcgagttgatcgaaggagaagcgaatccctgcaacatctgtggcaagacttttactttcaactctgatctggtgaggcacaggataagccatgcgggtgaaaaaccttacacttgcgatcagtgcggcaagggtttcggacaatccagtcacttgatggaacaccagcggattcataccggcgaaaggttgtatgtgtgtaatgtctgcggtaaagacttcattcactacagcgggctgatcgagcaccagagagtgcactcgggcgagaaaccgtttaagtgtgcccagtgcggcaaggcattctgccattcctctgatttgatcaggcatcaaagggtccacacgagagaaagaccattcgagtgtaaagagtgcggcaaggggttctcacagtccagtttactgattaggcaccagcgcattcacactggcgaacgcccttatgagtgtaatgaatgtgggaagtccttcatccggagtagctcattaattagacactaccagattcacactgaggtgaaacagtacgaatgcaaggaatgcggcaaggcctttcgacaccgctcagacctgatagagcaccagaggatccacacaggcgagagacctttcgagtgcaacgaatgtgggaaggccttcatccgttccagcaagctcatccaacaccaacgtatacatactggagaacgcccatacgtgtgtaatgaatgcggcaagcggttcagccagacatccaatttcactcagcatcagagaatacatactggcgagaagctgtacgagtgcaacgagtgtggaaaggcttttttcttgtcttcctacctgatccgtcaccagaaaattcatactggtgagcgtgtatatgagtgcaaggaatgcggtaaggctttcctccaaaaagcccatctcacagagcatcaaaaaattcactctggagacagaccattcgaatgcaaagactgcggcaaggccttcatccagtcatctaagctcttgctgcaccagattatacacacaggggagaaaccctatgtctgttcttattgcggcaagggctttatccagcgttcgaatttcttgcaacatcagaaaattcacacagaagagaaactctatgaatgtagccagtacggaagggactttaattctaccactaacgtgaaaaataaccagcgcgtgcatcaggagggtctaagcctgtctaaagccccaattcatctcggagagaggtcggtagataaaggggagcacacgggcaatctgtag

SEQ ID NO: 25636 - DNA, 1611 bp, Artificial Sequence
  Description of Artificial Sequence: Synthetic coding sequence
atgatcctcttaagcttcgtctcagactccaacgtcgggacgggggaaaaaaaggtgaccgaagcctggatatctgaggacgaaaattctcacagaactaccagcgataggcttacagtgatggagctgccgtcacccgagagcgaagaggttcacgagcccaggctgggcgagttgcttggtaaccctgagggccaaagtctcggtagctcacccagtcaggatagagggtgtaaacaggtgactgttactcactggaaaatacagacaggggagaccgcccaagtgtgtacgaaaagtggcaggaaccacattctcaactccgatctactgcttctccagcgggagctcattgagggggaagcaaacccgtgtaacatctgcggaaaaacgttcactttcaatagcgatctggtgaggcaccggatctcacatgctggagagaagccttacacctgtgatcagtgcggaaaggggttcggccagtcctcgcacctgatggagcatcagaggattcacacaggtgagcgcctttatgtatgtaacgtgtgcggcaaagattttatacactacagtggactcatcgaacatcagcgggtgcacagcggcgagaaacctttcaagtgcgcacagtgcgggaaggcattttgccactcctccgacctgatacggcaccaaagagtgcacacgcgcgagcgaccatttgagtgtaaggaatgcggcaaagggttctcgcaatcatccttgcttattagacaccagagaatccatacaggcgaacggccttatgagtgtaatgagtgtggcaagagttttatccgctctagtagcctcattcgacattaccagatccacaccgaagttaagcagtatgaatgtaaggaatgtggcaaggcttttcggcatcggagcgacctgatcgagcaccagcgaattcatacaggcgagcgtccattcgagtgtaacgaatgcggcaaagcgtttattcgcagttctaagctgattcagcaccagcgcatccacactggagaaagaccatatgtttgtaatgaatgcggcaagcgcttttcccagacttccaatttcacacagcatcaaagaatccacacaggagagaaactatacgaatgcaatgaatgtgggaaagcgttcttcttgtctagctacctaatccgccatcagaagattcataccggagaacgcgtctatgagtgcaaggagtgcggaaaggcttttctccagaaagcccacctgactgagcaccagaaaattcacagcggggacaggccgtttgagtgcaaagactgtggcaaagcttttattcaatctagtaaattactgctgcaccagattattcacaccggggagaagccatacgtgtgtagctactgcggcaaaggattcatacagcggagcaattttctacaacaccaaaaaatccacacagaagagaaactctatgaatgcagtcaatatggcagggactttaattctacaaccaacgtgaagaacaatcagcgtgttcaccaggagggcctttctctgtctaaggcgccaatccatctgggggaacggagtgtggacaaaggagagcatacaggaaatctttag

SEQ ID NO: 25637 - DNA, 1491 bp, Artificial Sequence
  Description of Artificial Sequence: Synthetic coding sequence
atggaactccccagcccagaatctgaggaagtgcacgaacccaggctgggcgagctgttgggcaatcctgagggacaatccttgggctcatccccttctcaggaccggggatgcaaacaggtgacagtcacccattggaaaatccagacaggagaaacagctcaggtctgcaccaagtccgggcgtaatcatatactgaactcggacctgctcctgctgcagcgcgagctcattgaaggggaagccaatccctgtaacatttgtggcaagacctttaccttcaactcagacctggtgcgacaccgaatctcacacgcaggtgagaaaccttacacatgtgaccagtgcggcaagggcttcggacagtcgagccacctgatggaacatcagaggatccacaccggtgagcggttgtacgtctgtaacgtctgtggaaaagactttattcactactctgggctcatagaacatcaaagagttcatagcggcgaaaagccgttcaaatgcgcacagtgtggaaaggcattctgtcacagcagcgatctgattcgtcaccagcgcgtgcataccagagaacgtccctttgagtgtaaagagtgcgggaaggggttctcacagagcagcttactgatcagacaccagaggatccacaccggggaacggccatatgagtgtaatgagtgcgggaagtcctttataaggagctcctcactgatacggcactaccagatccacactgaggtaaagcaatacgagtgcaaggagtgcggcaaggcattcaggcatcggtcagaccttattgaacaccagagaatccacacaggggagcggccattcgaatgcaatgagtgcggtaaggcttttatcagatcctcaaagctaattcagcatcagaggattcatacgggggagcgtccctatgtttgcaatgagtgtggcaaaagattctcacaaacttctaactttactcagcatcagagaattcacaccggtgagaaactgtacgaatgcaatgagtgcggcaaggcgttcttcctctccagctatctcatcaggcaccagaaaattcacacaggcgagagggtttatgagtgcaaagagtgcgggaaggctttcttgcagaaagcacacctcacagagcaccaaaagattcattctggcgacagaccgtttgagtgcaaagattgtggcaaggccttcatccagtcatctaagcttctactccatcaaatcatccataccggggaaaagccgtacgtgtgctcctattgcgggaagggctttatccagaggagcaacttcctgcagcaccagaagatacacacagaagaaaagctctatgagtgttcccagtacgggagggatttcaactccaccaccaatgttaaaaacaatcagcgggtgcaccaagaagggctgtctctcagcaaagccccaattcacctgggggaacgttctgtggataagggcgaacataccggcaatctttag

SEQ ID NO: 25638 - DNA, 1611 bp, Artificial Sequence
  Description of Artificial Sequence: Synthetic coding sequence
atgatcctgttgtcgtttgtgtccgatagcaatgtgggcaccggagagaagaaagttaccgaagcctggatctctgaggatgagaactcccacaggaccacctccgatagactgactgtgatggagttaccgagtcctgagtccgaggaggttcatgagccaagactgggtgagctgttgggaaacccggaggggcagtcactgggttccagtcctagccaggatagggggtgtaagcaggtcactgttacgcactggaaaatccagactggggagactgcccaggtgtgtacgaagagcggcaggaaccacatactgaattccgacctgctgttactacagagagagctgatcgagggtgaagcaaatccatgcaacatctgcggtaaaaccttcactttcaattctgacctcgtgcgccacaggataagccatgccggagagaagccatacacatgcgaccagtgcggtaaaggtttcggccagtcaagccacctgatggagcaccagcgcattcatacaggcgaacgactctacgtctgtaatgtgtgtgggaaggatttcattcactactctggcctgatcgaacatcagcgagtacattcgggcgaaaagccattcaaatgtgcacagtgtgggaaggcattctgtcactcttcagacctgatcagacaccaacgggtacatacgagagaaagacccttcgagtgtaaggaatgcggaaaaggattttcccagagcagtctcctgattagacaccaaaggatccataccggtgagaggccctacgagtgcaacgaatgcggcaagagtttcattcgcagttcttcactcattaggcattaccagattcacactgaggtgaagcagtacgagtgtaaagaatgtggaaaggcgtttcggcaccgaagcgacctgatcgagcatcagcgtatccacaccggtgagcggcctttcgagtgcaatgaatgtggcaaagctttcattcgttcctcaaagctgatccaacaccagagaattcacacaggtgagaggccatacgtctgtaatgaatgtggaaagcgcttttcccagaccagtaattttacccagcaccagcggatccataccggagaaaagctgtacgaatgcaacgagtgtggcaaggccttcttcctctcaagctatctgattcgacaccagaaaattcatactggggagcgagtctacgaatgcaaggagtgcgggaaggcattcctccaaaaagcccatctgaccgagcaccagaagatccactctggcgaccgtcccttcgaatgcaaggattgcggtaaggcgttcatacagtctagtaagcttctgctgcaccagatcattcacacaggagagaaaccctacgtctgctcttactgcggcaagggattcatccaacgctccaatttcctacagcaccagaaaatccacacagaagagaaactgtacgagtgttctcagtatggtagggacttcaactccaccaccaatgtgaaaaacaaccagcgcgtacaccaagaaggactctcactgagcaaggcaccaattcaccttggcgagcgatctgtggacaagggagaacataccggaaacctatag

SEQ ID NO: 25639 - DNA, 2598 bp, Artificial Sequence
  Description of Artificial Sequence: Synthetic coding sequence
atgagcttgcaagattctaccctgtcgcgggagggaaagcccgagggcgaaatcatggccgcagtgttctttagcgttggacggttatccccagaggtgacacaaccagatgaagacctgcacctccaggcagaagagactcaactcgttaaggagtccgtcacctttaaagatgtagcaattgatttcacccttgaagagtggaggctcatggatcctacccagagaaatttgcataaggacgtgatgcttgagaattaccgtaacctggtgtcactagggctggcggtgtcaaagcccgatatgatcagccacttagagaacggaaaaggaccatgggtgactgttagggagatttcgcggatcccttatcccgacatggaaccaaagcctgcaactaaaaaggccacccgaacaaaagccatctcggaggacttgagccaggaggccatcctcgaaaaactgactgaaaatggcttgtgggactctcgcatggaaggtctgtggaaatggaacgaccgcattctgaggctccaaaacaaccaggaaaatcacctgtcccaaagaataatcccgctcaaaaagactcctacatcccaacggggatttcggtttgagtccattttgatcccagagccaggtatcgccacagaggagcttcacagccgatgtcaaactcaggaagagaatttcactgaaaacctcaacctcataaccgatactcacctaggtaaaattatctgtaaagaaatgaaaggaagcaaggctatcagacagacatcagaactaacactgggaaagaagtccaataataaagaaaagccctataaatgctccacttgcgaaaaggcatttcattataggagcctgttgattcagcaccagcggacccacacgaaggagaaaccatacgaatgcaacgaatgcgggaaaacgttcagccagcccagctatttatcccaacacaaaaagattcacaccggggagaaaccatacaagtgcaatgaatgcgggaaggccttcatcgcctctagctctttgatggtccatcagagaattcacactaaagagaaaccataccagtgcaacgtgtgcggtaagtctttctcccagtgtgccaggctgaaccaacaccagcgcatacagaccggggagaaaccttacaaatgctcagagtgcgggaaggcattctccgataaaagcaagctggctagacaccaagaaacccataatggcgagaagccatataagtgcgatgattgcgggaaagcttttaggaataaaagctacctgagcgtgcaccagaagactcatactgaggagaagccttatcagtgtaacgagtgcgggaaatctttcaaaaacaccactatctttaacgtccaccagagaatacacaccggtgaaaagccctttcggtgcaacgaatgtggtaaggcatacagatctaattcatcgcttattgtgcatattagaacacatactggagaaaagccttatgaatgcaacgagtgtggaaaagcattcaaccgcatcgctaacttcacagagcatcagcgaatccatacaggggaaaagccttacaaatgtaacgagtgcggcaaggcttttatcaactacagttgcttaactgtccaccatcgaatgcacacaggcgaaaaaccatataaatgcaccgaatgcgggaaagctttcatgcgaagttcttccctgataattcaccagcggatacacacagaggagaagccctacttatgcaacgaatgtggagagtccttccggatcaaatctcatctaaccgtacatcagaggatccatacaggggagaagccatataaatgtacagattgcgaaagagctttcaccaagatggtgaatctgaaagagcatcagaaaattcacacgggcgtcaagccatataaatgttatgattgtggcaagtctttcaggaccaaaagttacctgatagttcatcaacgcactcacactggcgagaaaccctataagtgtaacgagtgtgaaaaggcgttcaccaacactagccagttgacagttcaccaacgccgtcacactggggagaagccctacaaatgtaatgagtgtggaaaagtattcaccagcaattccggcttcaacacccatcaaaggacacatacgggagagaagccctttaaatgcaatgattgcggcaaagccttcagccagatggtccatgtgacagaacaccagaagattcatagtggcgagaagccatacaagtgtgatgtctgtggtaaggcctttcgaaggggatcttatctcacagtgcactggcggacccacactggcgagaaaccatacacctgcaaggagtgcggaaagggatgcattaccctatctcagctcactctgcatcagagaatccacactggcgagaggccttacaagtgcgaagaatgcggaaaggccttcagaaccaattctgattttaccgtgcacctacggatgcacacaggagaaaagccctacaagtgtaatgagtgcgggaaggcttttaggagtagctcatctttgactgtacaccaacgcatccatcagcgcgagacacagttgatttag

SEQ ID NO: 25640 - DNA, 336 bp, Artificial Sequence
  Description of Artificial Sequence: Synthetic coding sequence
atgagcctgcaagatagtacgctctcaagagaaggcaagcccgaaggagagatcatggctgccgtgtttttttcagtgggcagactatcacccgaagttacgcagccggacgaggatctacacctgcaagccgaggaaacccaattagtcaaggagagcgtaacgtttaaagatgtggccatcgatttcactctagaggaatggaggcttatggaccccactcagagaaacctccataaggacgtgatgctggagaattacaggaacctcgtttcattgggattggccgtatccaagccagatatgatctcgcatctcgaaaacggaaaaggctag

SEQ ID NO: 25641 - DNA, 921 bp, Artificial Sequence
  Description of Artificial Sequence: Synthetic coding sequence
atgggtgaacgcctgctggagtcaaaaaaagatcatcaacacggtgaaatcctcacccaagtgccggacgacatgctgaaaaagaagacccccagagtgaaaagttgcggtgaagtgtcggtcggtcatgcatccctgaataggcatcaccgagctgataccgggcacaagccatatgaataccaggagtatgggcagaaaccttacaagtgcacttattgtaaaaaggctttctccgacctcccctacttcagaactcacgaatgggcacataccggcggtaagccctatgattgtgaagaatgtgggaagagtttcatcagccggtcctcaattcgccgacaccgcattatgcattctggagacggaccatataagtgtaatttctgcgggaaagcactgatgtgtctgagcctctacttaatccataaaagaacacatacaggagaaaagccgtatgaatgtaagcaatgcggaaaagcctttagccatagtggcagcctgcggattcacgagagaacgcacacaggggaaaagccctacgaatgtagcgagtgcggcaaggccttccacagttcaacatgcctacacgctcataagatcacacatacaggagaaaagccttatgagtgcaaacagtgtggcaaggctttcgtctccttcaactcagtaaggtatcacgagcgcacccacacaggtgaaaagccttatgagtgtaagcagtgcggtaaggcattccgctcagccagccatcttaggacccacggcaggacccatactggcgaaaaaccatacgagtgtaaacaatgcgggaaagccttcggctgtgcgagcagcgtaaaaattcacgagcggacccacaccggcgaaaagccttgctccagcaacacatcaaagggccagggagaaaagatagcttag

SEQ ID NO: 25642 - DNA, 1119 bp, Artificial Sequence
  Description of Artificial Sequence: Synthetic coding sequence
atggatagtgttgtttttgaagatgtggacgtgaatttcacccaggaagagtgggccctgctggaccctagccaaaaaaacctttatcgggacgttatgcaggagacctttcgtaatcttgctagtgtcggcaaaaaatggaaagaccaaaaaatcgaagatgagtataagaatccccgaaggaatctccgcggtctcatgggagagcgacttctggaaagcaagaaggatcatcagcatggggagatcttaactcaggtgcctgacgatatgctcaaaaagaagacaccccgagtgaaatcatgcggggaggtttctgttggccatgcaagtctgaaccgccatcatcgcgctgatactgggcacaagccgtatgagtaccaagagtacgggcagaaaccatacaagtgcacctactgtaagaaggccttctccgacttgccttacttcagaacacatgaatgggctcacaccggcggaaagccgtacgattgtgaggaatgcgggaagtcattcatttctagatcaagcatccgtcgccaccgcataatgcattctggcgatggcccttataagtgcaacttttgcggtaaggcactcatgtgcttgtcactctatctgattcacaaacgaacccacacgggcgagaagccatatgagtgcaaacagtgtgggaaagcattcagccatagtggatccctgcgtatccacgaacgaactcacaccggcgagaaaccttacgaatgttccgagtgcggaaaggcatttcatagctctacatgcttgcacgcacacaagatcacccacacaggcgaaaaaccttatgaatgtaagcagtgcgggaaagcctttgtgtcctttaatagtgtaagataccacgaacgcacgcacaccggggaaaaaccttacgagtgcaaacagtgcgggaaagcgtttcggagtgcctcccaccttcgcactcacgggaggacacatacaggcgagaaaccttacgagtgcaagcagtgtggaaaggctttcggctgtgcttcatctgtgaagattcatgaaaggactcacaccggggaaaagccttgtagctcaaatactagtaaaggccagggcgaaaaaatagcgtag

SEQ ID NO: 25643 - DNA, 921 bp, Artificial Sequence
  Description of Artificial Sequence: Synthetic coding sequence
atgggagagcggctgttggagagcaagaaggatcaccagcatggcgagatccttacacaagtgcctgatgatatgctgaagaagaagaccccacgcgtcaaaagttgcggcgaagtaagcgtaggccacgcgagcctgaaccgccaccaccgagcagataccggccataagccctatgagtatcaggaatacggccagaagccttacaaatgcacgtattgtaaaaaggcctttagcgacctgccctactttaggacccacgagtgggctcataccgggggaaaaccctatgattgtgaggagtgcggtaagagctttatctccaggtcaagtatacggagacatcgcatcatgcattctggagacggtccatataagtgcaatttttgcgggaaggccctcatgtgcttgtcactgtacctgattcacaaacggacgcacaccggcgaaaaaccttacgaatgcaaacagtgtggtaaagctttcagccattcggggagtctccggattcacgaaagaactcataccggagaaaaaccatatgaatgctcagagtgtggaaaagcttttcactcttcgacgtgtctccatgcccataagatcacacatacaggagagaagccttacgaatgcaaacaatgcgggaaggcttttgtgagtttcaactccgtcaggtaccatgagaggacacatactggggaaaagccgtacgaatgtaaacagtgtggtaaggcattcaggagcgcttctcacctgagaacccatgggaggacgcatacaggcgaaaagccttatgagtgtaagcagtgtggcaaggccttcgggtgtgcatctagtgtgaagatccatgaaagaacacataccggggagaagccatgcagtagcaacaccagtaaggggcaaggagagaaaattgcctag

SEQ ID NO: 25644 - DNA, 279 bp, Artificial Sequence
  Description of Artificial Sequence: Synthetic coding sequence
atggggccattgcagttcagagatgtcgccattgaattcagtctcgaggaatggcactgtcttgatacggcgcagaggaatctctataggaatgtaatgcttgaaaattattccaacctggtctttctaggtattacagtttccaaacccgacctcatcacttgccttgagcagggtcggaagcccctgaccatgaaaaggaacgagatgattgcaaagccatctgtgagcttcctacaggtgcacagcgaatcccagagccctttgcacgatatctag

SEQ ID NO: 25645 - DNA, 1623 bp, Artificial Sequence
  Description of Artificial Sequence: Synthetic coding sequence
atgggacctctacagtttcgggacgttgcaatcgagttttctctggaggaatggcactgcctggatacagcacagcgaaacctgtaccgcaatgtaatgcttgagaattactctaacctcgtcttcctcggcatcaccgtgtcaaaacccgaccttattacttgcttggagcagggaagaaagcccctgacgatgaagaggaacgagatgattgcaaagccgtcagtgatgtgttcccacttcgcacaggacctctggcctgagcagagcatgaaggattccttccagaaagtggttctgcgcaggtatgagaaatgcgaacatgacaacttgcagcttaagaagggatgtatctctgtggatgagtgtaaggtgcacaaagaggggtacaatgagctgaaccagtgccttactactacgcctagaaaaatttgtcagtgtgataagtatgtgaaggtcctgcaccagttccctaattcaaatggccagaaaaggggccataccggtaaaaagccctttaagtatatagaatgtgggaaggctttcaagcagttttccaccttaacaactcataagaaaattcatacagggggaaagccttataaatgcgaggagtgcgggaaggcgtttaaccatagctgctctcttactagacacaaaaaaatccacacgggcgaaaagccctacaaatgcgaagagtgtggcaaggccttcaaacatagttcgacccttacaacccataagaggaaccacacaggggagaaaccatacaaatgcgacaaatgcggtaaggcatttatgtctagtagtaccttaagcaagcatgagatcattcacacagagaagaagccttacaagtgtgaggagtgcgggaaagccttcaacagatcgtccacactgaccactcacaagataatccacaccggtgagaaaccctataagtgcgaagaatgtgacaaggcgttcaagtattcatacactttgactacacataaacggattcacacagaggataagccatataagtgtgaagaatgcggcaaggcttttaagtattctagcacattaaccacccataaaaggattcacacaggagaaaaaccttataagtgcgaggagtgcggcaaggcctttaagcgcagtagcgacctgacaacacacaagatcattcacaccggagaaaagccgtacaaatgtgaggaatgcggtaaagccttcaagtattcctccaatcttactacccataagaagatccacacgggagaacgtccctacaaatgcgaggagtgtggaaaggcttttaaccaaagctctatcctcactacccacaggcgcatacacacaggggagaaattttataaatgtgaggaatgtgggaaagccttcaaacgcagctcacacctcactacccataagattatccacaccggtgaaaagttctataagtgcgaggaatgcgacaaagcattcaagcatttttcaaatcttaccactcacaagaaaatccacaccggtaaaaagccctatagatgtgaggaatgtggtaaggcctttaaacattcttcgaagctcaccacgcacaaaaggttccacactggggagaagccgtatcggtgtgagtag

SEQ ID NO: 25646 - DNA, 1587 bp, Artificial Sequence
  Description of Artificial Sequence: Synthetic coding sequence
atgggacctctgcagttccgggacgtggccatagagttctctctggaggaatggcactgtctggacacagcacaacggaacctttaccggaatgtcatgctggagaattacagtaacttagtgttcctggggatcacagtgtccaaacccgacctgattacctgccttgaacaaggtcggaaacctctgacgatgaagcgtaacgagatgatcgccaagcctagcgtaatgtgttctcacttcgcccaagacctctggcccgagcagtcaatgaaggacagcttccagaaagtggttcttcggcgttacgagaagtgtgaacacgacaacttacagctcaaaaagggttgcatttcagtagacgaatgcaaggtccataaggaggggtataatgagctgaaccaatgtttaacgactacacccagaaaaatctgtcagtgcgacaagtacgtgaaggtccttcaccaatttccaaactcgaacggacagaagcggggtcataccgggaagaaaccctttaagtatatagaatgtggaaaggcctttaaacagttcagcacactcactacacacaagaaaatacacaccggaggaaaaccctataagtgcgaggaatgtggtaaggcattcaaccactcttgctcacttactcgacacaaaaagatccataccggcgaaaagccttacaagtgtgaagagtgcggcaaggcgtttaaacattcctccaccctcactactcataagagaaaccatacaggcgaaaaaccttacaaatgcgacaaatgtgggaaggcctttatgtccagctctaccctgagcaaacacgagatcatccacaccgaaaaaaagccatataaatgtgaggaatgcggcaaggccttcaaccggtcttcgaccctcacaacacacaagattatacatactggggaaaaaccttacaaatgcgaggaatgcgacaaagccttcaaatacagttatacactgaccactcataagcggatacatacagaagacaagccatacaaatgcgaggagtgcgggaaagcttttaagtattctagcacgctgacgacccacaaaagaatccatactggagagaaaccttacaagtgcgaagagtgcggaaaggcatttaaacgatcttccgatctcacaactcacaagattatccacacaggcgagaagccatataaatgcgaagaatgcggtaaggcattcaagtacagttcaaatctgacaacgcacaagaagatccacactggcgagcggccatacaagtgcgaagagtgtggaaaagccttcaatcaaagctctatcctgacaactcaccgcaggatccatactggcgaaaaattctacaaatgcgaagagtgtggcaaagcattcaagtgttcatctaatctcaccacccataagaagattcacactggagaaagaccctacaagtgcgaagagtgtggaaaggcgtttaatcaatcgagcatcctgaccactcacgaacggattattttagagagaaattcaacaaatgtaaaaaacgtcgcaaagccatcctcaggcccacatactctccttcatattcggtag

SEQ ID NO: 25647 - DNA, 1359 bp, Artificial Sequence
  Description of Artificial Sequence: Synthetic coding sequence
atgtgtagccacttcgcgcaggatctgtggcctgagcagagtatgaaggattcttttcagaaagttgtgctgcgccgatatgaaaaatgcgaacacgacaacctccagctgaagaaaggttgcattagtgtggacgagtgcaaggtgcataaggagggctacaatgaattgaatcagtgccttacaacgactcctaggaaaatttgccaatgcgacaagtacgtcaaagttctgcaccagttccctaatagcaacggccagaagcgcggacatacagggaagaagcctttcaaatacattgagtgcggcaaagcatttaagcagttttcgacactcactacacacaagaaaatccacacgggtggaaagccttataaatgcgaggagtgcggtaaggcttttaaccactcatgcagcctgacaaggcataaaaagattcacactggtgagaagccctacaaatgcgaggagtgcggtaaggcatttaaacattcttccacactgaccacacacaaaaggaaccatactggggagaagccttacaagtgcgataagtgcggtaaggcgtttatgtcctccagcacactatctaagcacgagatcatacataccgaaaagaagccatacaaatgtgaggagtgtggcaaggcctttaaccgtagcagtacacttacgactcataaaattatccacaccggcgagaaaccttataagtgcgaggagtgtgataaagcattcaagtacagctatactctgactacccataagcgaattcataccgaggataagccgtataaatgcgaggaatgtggcaaggcatttaagtactctagcacactgacaacacacaagcgaatccataccggagaaaagccctataagtgtgaagaatgcgggaaagcattcaagcgatcatccgaccttaccacacataagatcatacacactggcgaaaagccttacaaatgtgaggagtgcgggaaggcctttaagtattctagtaatttgacaacccacaaaaaaattcatactggagagaggccatacaaatgcgaagagtgcgggaaagcctttaaccagtcatcgatcctgaccacccataggcgaatacatacaggcgagaaattttacaaatgcgaagaatgcggcaaggcattcaagtgttcctccaatctgacgactcataaaaagatccataccggcgagcggccttataaatgcgaggagtgcggcaaagcttttaaccagtcctccattcttacgacccacgaacgcatcattctggagcgtaatagcacgaatgttaagaacgttgcaaaaccatctagcgggcctcataccctgctccatatcagatag

SEQ ID NO: 25648 - DNA, 1587 bp, Artificial Sequence
  Description of Artificial Sequence: Synthetic coding sequence
atgggtcctctgcagtttcgcgacgttgccatcgagttttctctagaagaatggcattgtctcgacacagcccagcggaacctctatagaaacgtgatgttagaaaactatagcaacctggtgtttctcggtattacagtcagtaaacccgatctgatcacatgccttgaacaggggagaaagccattgacaatgaagcggaatgagatgatagccaaaccttctgtaatgtgctctcacttcgcacaggatctgtggcccgagcagagtatgaaggacagctttcagaaagtcgtgttgcggagatacgaaaaatgtgaacacgacaacctgcagctcaagaaggggtgcattagtgttgatgaatgtaaggtccataaagagggatataatgagctgaaccagtgcctgaccaccacacccaggaagatctgtcagtgtgataaatatgtgaaggtgctccatcagtttccaaattctaatggtcaaaagagggggcatacaggcaagaaaccattcaagtatattgaatgcggcaaggcctttaaacaattctccaccctcactacacacaagaaaatacacacggggggtaagccttacaagtgcgaagaatgcggaaaggcctttaaccactcttgctcactcactcggcacaaaaaaattcatacgggtgaaaaaccctataagtgcgaggagtgcggcaaggccttcaagcatagctctactctaaccactcataagcgcaaccatacaggagagaaaccctataagtgcgacaagtgtgggaaggcgttcatgtccagcagcactctgtccaaacatgagattatccacacagagaagaagccttacaagtgtgaggaatgcggaaaggcttttaatcggagttctaccctgacaacgcacaaaatcatccacacaggcgagaagccctacaagtgtgaggagtgcgataaggcttttaagtattcatacactctcacaacccacaagcggatccataccgaggataagccctataagtgtgaggagtgcggaaaagcctttaaatattcaagcactcttacaactcacaagcgaatccacacgggagaaaagccgtacaaatgcgaggaatgcggcaaagcgttcaaacggagctcagatttaaccactcataagatcattcacaccggagaaaagccctacaagtgtgaggaatgcggaaaggccttcaagtattccagcaatctgactacgcacaagaagatccatacaggagaaaggccctacaaatgcgaggaatgtgggaaggcgtttaaccagtccagcatccttactacacaccgacgtatccacacaggggagaagttctacaagtgtgaggagtgtggcaaggccttcaagtgctcttcgaatctgaccacccataagaagatccataccggggagcgaccttataagtgtgaggagtgtggcaaggcgtttaaccagtctagtatcctgacaacccacgagagaatcattcttgagagaaattccaccaatgtgaagaacgttgccaaacccagctccggcccacataccctactccacatacggtag

SEQ ID NO: 25649 - DNA, 2610 bp, Artificial Sequence
  Description of Artificial Sequence: Synthetic coding sequence
atggaaccagagactgccctgtggggacctgatttacagggccctgagcagtccccaaatgacgcccaccgtggggcagagtccgagaatgaagaagagagtcctcggcaggagtccagcggggaggaaatcatcatgggagacccagctcagtcacctgagtctaaagacagcacagagatgtccctagagcgaagtagtcaggacccaagcgtgcctcagaatccacccacaccactgggccactctaaccctcttgaccaccaaataccccttgacccccctgctcccgaagtggttcctaccccttcagattggacaaaggcctgcgaggcctcctggcaatggggggctttgaccacctggaactctcccccagtggtgccggcaaacgagccgagtctgcgcgaacttgttcaggggaggccagctggagcggagaagccttacatctgcaatgagtgtggcaagtctttctcccagtggtcgaagcttcttaggcaccaacgtatacatactggagagcgccctaatacttgttctgagtgtggaaaatcttttacccagtcctctcaccttgttcagcaccagcgcacccacaccggagaaaagccttataagtgccctgactgcggcaagtgcttttcctggtcttcgaacctggtgcagcaccagcgcactcacactggagagaaaccgtataagtgcactgagtgtgagaaggctttcacccagtctacaaatttgatcaagcatcagcgaagccatactggagaaaagccttataaatgtggagagtgcaggagggcattttacaggagtagtgacctgatccagcatcaagccacgcataccggggaaaagccctataagtgtcctgagtgtgggaagcggtttggtcaaaaccataacttactgaagcaccagaaaattcatgccggagaaaaaccctaccggtgtaccgaatgtggtaagtctttcattcagtcaagcgaactcacccaacaccaacgcacccacacaggcgagaaaccatacgagtgcttggagtgcgggaagagtttcgggcactcatctactctgatcaagcatcagcgcactcatctgcgggaggacccttttaagtgcccagtgtgtggaaagacttttactctttccgctacccttctccgtcaccagcgcacgcacacaggtgaacggccttacaaatgccctgaatgtgggaaaagtttctcagtgtcttcaaaccttatcaatcaccaacgcatccatcgcggagagaggccttacatttgcgcagattgtggcaaaagcttcatcatgtcgagcaccctgatcaggcaccagcgtattcatacgggagagaagccatacaagtgctcagattgcggcaaatcattcatacggagcagtcacctcatacagcacaggcggactcacacaggtgagaagccctacaagtgtcccgaatgtgggaaatcgttctctcaaagtagcaaccttatcacccatgtcagaactcatatggacgagaatttattcgtgtgcagtgattgcgggaaagctttcctggaggcacacgagttggaacagcacagggtaattcatgaacggggaaagaccccagccaggagggctcagggcgacagtcttttgggtcttggcgaccccagcctactgacgcccccacccggagcaaaaccccacaaatgcctggtttgtggcaagggcttcaatgacgagggaatctttatgcagcaccagcgcatccatatcggcgagaacccttacaaaaatgcagatggtctcatcgcccatgctgctccaaaaccaccccaactgaggagccctagactgccttttaggggtaatagctaccccggagccgctgaggggcgagccgaagctcccggtcaacctctcaaaccaccggaaggacaagagggctttagccagcgtcgaggtctcctgtctagcaaaacatacatttgcagccattgtggcgagtcctttctcgatcggtcagtactgttacagcatcagcttacgcacggcaacgaaaaacctttcctcttccccgactatcgcattgggctgggagaaggcgctggacccagcccattcctgagtggcaagccattcaaatgtccagaatgcaaacagtcattcgggctcagttccgaattgctgctgcaccagaaagtacacgccggaggcaagagcagccaaaagtcccctgaactggggaagtcttcctccgtgcttttagagcatctgcggtcgcccctgggggctcggccatacaggtgctcagattgccgggcaagcttcctcgatcgtgtggccttgaccaggcatcaggagacacacacccaggagaagcctcctaatcctgaggatccacctcccgaagcagtgaccctgagtaccgaccaggaaggagagggcgaaacgccgaccccgacagagtcgtcctctcacggggaggggcagaaccctaaaaccctggttgaggagaagccatacctgtgtcctgagtgcggtgccggtttcactgaggtggccgcattgttgctgcatcggtcctgccaccctggtgtaagcctatag

SEQ ID NO: 25650 - DNA, 1458 bp, Artificial Sequence
  Description of Artificial Sequence: Synthetic coding sequence
atgaacgagtatcctaagaaacgcaaacggaaaacccttcacccctcccggtacagtgatagctctggcatttcccggatcgccgacggcttcaatgggatattctctgaccactgttattccgtgtgctccatgaggcagcccgacctaaagtattttgataataaggacgacgattccgatactgaaactagtaatgacctgcccaaattcgctgacggtattaaagcccgaaatcggaaccaaaactacctcgtgccttcacccgtcctgcgcatccttgaccacacagcttttagcacagagaaatctgccgatattgttatatgcgacgaagagtgcgactcacctgaatcagtaaaccagcagacacaggaggaaagtcccattgaagtgcatacagcggaagacgtgcccattgctgtggaggtgcatgcaatctccgaagactacgatatcgaaacagaaaataactcgagtgaatccctgcaagaccagaccgatgaagagcctcctgcaaaactgtgcaaaatcctggataagtcgcaggccctgaacgtaacggctcagcagaaatggccactgctgagggccaactcatccgggctttataaatgcgagttgtgtgaatttaattccaagtacttcagcgatctgaaacagcatatgatcctaaagcacaagagaactgattcaaacgtgtgccgggtgtgtaaagagtctttctctacaaatatgctgctcattgaacacgcgaagctacacgaggaggatccctacatctgcaagtattgtgactacaaaactgttatcttcgagaacctcagtcagcacatcgccgacacacattttagtgatcatttgtactggtgcgaacagtgtgatgtgcagttttcatcatcatcagagctttacctccacttccaagagcattcgtgtgacgaacaatacctctgtcagttctgcgagcacgaaactaatgatcccgaggatctgcatagccacgtggtgaacgagcacgcgtgtaaattgatcgagctcagtgataaatataataatggagagcacggtcagtatagcctgttgtccaaaattaccttcgataaatgtaagaacttttttgtctgtcaagtttgtggtttccgttcacgactgcataccaacgtcaaccggcatgtggctattgaacataccaaaatttttccacatgtgtgcgatgactgtggtaagggcttttccagcatgctcgagtactgtaagcacctgaattcccatcttagcgagggaatttatctctgccagtactgtgagtactcaaccggacagatcgaagacctgaaaatccacctcgatttcaagcacagcgccgacctgcctcataagtgtagcgactgcttaatgcgcttcgggaatgaacgggagttaatttctcatcttccagtgcatgaaacaacctag

SEQ ID NO: 25651 - DNA, 867 bp, Artificial Sequence
  Description of Artificial Sequence: Synthetic coding sequence
atgaatgaatacccaaaaaagagaaagcgcaagacgcttcatccatcaaggtatagcgatagcagcgggatctccaggatcgcagatgggttcaacggcatcttcagtgatcattgctacagcgtgtgtagcatgaggcagcctgatctcaagtattttgataataaggatgacgattcagataccgagacgtccaatgatctcccaaagtttgcagatggcattaaagctcgcaaccgaaatcagaattatttggtgccgtcaccagtgctcaggatcctggaccacaccgccttcagcacagagaagtctgctgatatcgtcatctgtgatgaggaatgtgattccccagagagcgtgaaccagcagacccaggaggagagcccaatagaagttcacaccgctgaagatgttcctatcgctgttgaggtccatgcaatctcagaggattatgacatcgaaacggaaaataattcaagcgagtcattgcaggaccagactgacgaggaaccccctgccaaattgtgtaaaatcctcgacaaaagccaggccttgaacgtgaccgcacagcagaagtggcccctactaagagccaatagttcaggcttgtataaatgtgagctgtgtgaatttaatagcaaatatttttcagacttgaaacaacatatgatccttaagcacaaacgcactgattcaaatgtgtgccgggtctgtaaagagtccttctctaccaatatgctcttaatagaacacgctaagcttcacgaggaggacccttacatttgcaaatactgcgactacaagaccgtgatttttgaaaatctgagccaacacatagctgacactcatttcagcgatcacctctag

SEQ ID NO: 25652 - DNA, 414 bp, Artificial Sequence
  Description of Artificial Sequence: Synthetic coding sequence
atgaacgagtatcctaaaaaacggaagcgtaaaacattgcacccctcaaggtatagtgacagtagcggcatttcaagaatcgcagatggttttaatggaatctttagtgatcactgctacagcgtctgttccatgcggcagcccgacctgaaatactttgataataaggacgatgatagcgataccgaaacgagtaacgacctgccaaaatttgcagacggaatcaaagccagaaatcggaatcagaactatctagtgccgtcaccagtcctgagaattctggatcacacagctttcagcacagaaaagtccgcagatattgtgatctgcgacgaggagtgcgattctcccgagtcagttaatcagcaaacccaagaagagagtcccatagaggtgcatacggccgaggattag

SEQ ID NO: 25653 - DNA, 1458 bp, Artificial Sequence
  Description of Artificial Sequence: Synthetic coding sequence
atgaatgagtatcctaagaagaggaagagaaaaaccttacacccgagccgatacagcgactccagcggaatctcgcgcattgccgatgggtttaatgggattttttctgaccattgttatagcgtgtgctccatgcggcaaccagaccttaaatactttgataataaagacgacgactccgacaccgaaacgtcaaatgacctgccaaagttcgctgacggcattaaggcaaggaatcgcaatcagaattacctggtaccgtcccctgtgctccgaatcctggaccatactgccttcagcaccgagaagagcgctgacatagtgatctgtgacgaggaatgtgactctccagagtcagtgaaccagcagactcaggaagaaagcccaatcgaggtgcatactgcagaggacgtgccgatcgctgtggaagtacacgctatcagtgaggactatgacatcgagacagaaaataattccagtgaaagtctgcaggatcagactgacgaggagcctcccgcaaagttgtgcaagattctcgataagtcacaggctctgaatgtgaccgctcagcagaagtggccgttgctcagggcaaactcaagtgggttgtataagtgcgaactctgcgagttcaattccaaatactttagcgatctaaaacagcacatgatcctgaagcataaacggacagactctaacgtttgcagggtgtgcaaggaatcattctctactaacatgcttttgatcgagcacgccaagttgcacgaggaggacccatacatatgtaagtattgcgattataagaccgttatttttgaaaacttgtcccaacacatcgccgacacccatttctccgatcacctctactggtgtgagcaatgtgacgtccagttcagtagctccagtgaactctatcttcacttccaggaacactcctgcgatgagcagtacctgtgtcagttttgcgaacacgagactaatgacccagaggatctgcacagccacgttgtgaatgagcatgcctgcaaattgatagaactttcagacaagtataataatggagagcatggccaatactcacttctttctaaaattacctttgacaagtgcaagaacttcttcgtatgtcaggtatgcggctttcggagtaggcttcatactaatgtcaataggcacgtggccatagaacacacaaagatctttccccatgtgtgcgatgattgcggcaagggattcagctcaatgctagagtactgtaagcacctcaatagtcatctatctgaaggtatctatctgtgccagtattgtgagtacagcactggacagatcgaggaccttaagattcatctggatttcaaacattcggcggatctgccccacaagtgttctgactgtctgatgcggttcgggaatgaacgggagctgatttcccacctgccagtgcatgagaccacctag

SEQ ID NO: 25654 - DNA, 651 bp, Artificial Sequence
  Description of Artificial Sequence: Synthetic coding sequence
atgaatgaatatcccaaaaaacgcaagaggaagaccttacacccgtccagatattctgacagcagtggtataagccgcattgcggacggctttaatggtatattttcagaccattgttactccgtttgcagcatgagacagccggatctaaagtatttcgacaataaagatgacgattctgacacagagacatcaaatgacttacctaaatttgcggacggcatcaaagcccgtaatcggaatcagaattatctggtgcctagtccagtgcttcggatcctggaccacaccgctttttcgacagaaaaaagtgccgacatagtgatttgcgacgaggagtgtgattcaccggaatctgtcaaccagcagactcaggaggagtctcctatagaggtgcatacagccgaagacgtgccaattgcagtggaggtgcatgccatcagtgaagactacgatatcgagactgagaacaacagcagtgagtccctgcaggatcagacagatgaggagcccccagctaaactgtgcaaaattctcgataagagtcaagccctgaatgttaccgcccagcagaagtggcccctgcttagggccaactcaagcggcctttataagtgcgagctgtgcgaattcaactccaagtacttttag

SEQ ID NO: 25655 - DNA, 393 bp, Artificial Sequence
  Description of Artificial Sequence: Synthetic coding sequence
atgaatgagtaccccaagaaaagaaagcgcaaaactcttcacccatctaggtatagtgattcttccggcatatcacggatcgctgatgggttcaacgggatctttagtgatcactgctatagcgtgtgctcgatgaggcagccagatttaaaatacttcgataataaggacgatgacagcgatacagagacctcaaatgacctacctaagttcgcggatggcatcaaggcaaggaatcgcaatcagaactacctggtacccagcccagtgttgcggatcctcgatcataccgcattcagtacagaaaagagtgccgacatcgtaatttgtgatgaggagtgcgacagccccgaaagcgtgaatcaacagacgcaggaggaatctcccatttag

SEQ ID NO: 25656 - DNA, 1458 bp, Artificial Sequence
  Description of Artificial Sequence: Synthetic coding sequence
atgaacgaataccctaagaagcgtaagagaaagacactgcacccgtcccggtactctgactcctccggaataagtcggattgctgacggctttaacggtatcttttctgatcattgctacagcgtgtgttccatgaggcagccagatctgaagtactttgacaataaagacgatgacagcgacacagagacctctaacgatttacctaaatttgccgatggaatcaaggccagaaatcggaaccagaattacctggtgccgagcccagtcttacgcattttggatcatactgccttctcaacggaaaagagtgctgacattgtgatctgtgacgaagagtgcgatagtcccgaatctgtgaaccagcagacccaagaggaaagccccatagaagtgcatacagccgaagacgtcccaatcgccgttgaagttcacgcgattagcgaggattacgacatcgaaactgaaaacaatagcagcgagtctctccaggatcaaacagacgaagagccaccggctaagctttgtaagattctggataagtctcaagccctcaacgtcacagcacaacaaaagtggcctctccttcgcgctaacagttccggattgtacaagtgcgagctgtgcgaattcaattccaaatatttcagcgatctcaaacaacatatgattctgaaacacaaacgtacggacagtaacgtgtgcagggtatgcaaggagtcattttccacaaatatgctccttattgagcacgccaagctgcacgaagaggacccatatatatgtaaatactgtgactataaaacggtcatatttgaaaacttgagccagcacatcgctgacacccatttttcggatcatctttattggtgtgagcagtgcgatgtacaattcagttcatcttcagaattgtatcttcacttccaagagcatagctgcgacgagcagtatctctgccagttttgtgaacacgagacgaacgatcccgaagacctacattctcatgtggtgaatgagcacgcatgtaaattgatcgaactgagcgataaatacaacaacggcgagcacggccagtactcactgctctcaaaaataaccttcgacaaatgtaagaattttttcgtatgccaggtctgtggatttcgttctcggttgcacaccaatgtaaaccggcatgttgccatagagcatactaagatcttcccccatgtctgcgacgactgcggaaaggggttcagctctatgcttgaatactgcaagcatctgaattcccacttgagtgagggaatctacctgtgtcagtattgcgaatactcaaccgggcagatcgaggaccttaagattcacctggactttaaacactccgctgatctccctcacaagtgcagcgactgcctgatgagattcggcaatgaacgggagctcataagccacctgccggtgcatgagactacttag

SEQ ID NO: 25657 - DNA, 1113 bp, Artificial Sequence
  Description of Artificial Sequence: Synthetic coding sequence
atggcagctgaacgccaggaagcacttagggaatttgtggccgtgacaggcgcagaagaggaccgggcaagattcttcttggagtcagctggttgggacttacagatcgcgctcgcctcattctatgaagatggaggagatgaagacattgtcacaatctcacaagccacaccctcctctgtgagcaggggaactgccccttcagacaacagggtgacatctttcagggacctgatccacgaccaggacgaggatgaagaggaagaggaaggacaaaggttctacgccggtggaagcgagagatccggacaacagatcgtcggcccacccagaaagaaatccccaaacgagttagtggacgatctgtttaaaggtgccaaggaacacggggcagtcgcggtcgaaagagtgacgaagtctcccggtgagacctccaagcccaggccattcgccggagggggatacaggctgggagctgcaccagaggaggagtccgcgtacgtggctggagaaaagcgtcaacattcatcccaggacgtacacgtcgtgttaaagctgtggaaatcaggattctccctcgacaacggggaactgcggagctaccaagatcctagcaacgctcaattccttgaatcaatccgtcgcggagaggtcccagccgaactccgcagacttgcccacggcggacaagtgaatctagacatggaagaccatagagacgaagactttgtgaaacctaaaggggctttcaaggcgttcacgggcgagggccagaagctgggatccaccgccccacaagtattatctactagctcccctgcacagcaggcagagaacgaagccaaggcatccagctcaatcttgatcgacgagagtgaacccacaacaaacatccaaattagactcgctgacgggggacggctggtgcagaaatttaatcactcacatcgaatcagcgatatccgactctttatcgtggacgccagacctgcgatggctgccacttcattcatccttatgacaactttccccaataaggaactggctgatgaaagccaaactctgaaagaggcaaacttgttaaatgccgtgatcgttcagcggctgacctag

SEQ ID NO: 25658 - DNA, 1884 bp, Artificial Sequence
  Description of Artificial Sequence: Synthetic coding sequence
atgaatgcatcttcggagggggaatcttttgcgggatccgttcaaattcctggaggaactactgtgttagtggagctgacaccagatatccacatttgtgggatctgtaagcagcaattcaacaatcttgatgcattcgtggctcataagcagtctgggtgccagctcaccggcacctcggccgctgctcccagcacagtgcagttcgtgagcgaggaaacagtgcccgcaacccaaacacagaccacaactcgaaccatcaccagcgaaacgcaaacgattacaggatgtcaatttaaaacagcctacggcatgaaggatatggaacggcacctgaaaatccataccggcgacaagcctcataaatgcgaggtttgcggcaagtgctttagtcgcaaggacaaactcaaaacacatatgaggtgtcacaccggggtgaagccttacaagtgtaagacgtgtgattacgctgctgctgacagttcctcactgaacaaacatctccggatccatagcgatgagcgaccatttaaatgtcagatctgtccgtatgcctccaggaattccagtcagctgacagtgcacctgcgtagtcacaccggagatgctccatttcagtgctggctctgtagcgcaaagttcaagatatctagcgatttgaaaagacacatgagagtgcactctggtgaaaagcctttcaaatgcgagttctgcaatgtgagatgtactatgaaaggaaaccttaagtcacatattcggattaaacactctggaaataattttaaatgccctcattgcgactttctcggggatagcaaagctaccctgcgaaagcatagccgagtccaccagtccgaacacccggaaaaatgttctgagtgctcttactcttgttccagtaaggcggctctgagaattcatgagcggattcactgcactgaccgccctttcaaatgtaactattgctcgtttgacacaaagcagccatcaaatttgtcaaagcacatgaagaaatttcacggagatatggtgaagaccgaagccctggagaggaaggataccggtaggcagtctagtcgtcaggtcgccaaactggacgcgaaaaaaagttttcactgcgatatttgtgacgcctcctttatgcgcgaagatagtttacgaagccataagcgccagcactctgaatactccgagagtaagaactcagatgtgactgtcctgcagtttcagatagacccgagtaagcagcccgcaactccactgacagtcgggcatctacaagttccactacagccttcccaggttccacagttctctgagggcagggtgaaaattattgtgggccaccaggtcccccaagctaacaccatcgtgcaggcagctgccgctgccgtgaatatagtcccaccagctctggtcgcgcagaaccccgaagagctgcccggaaattcgcgcctccagatcttgcggcaggttagcttaatcgctcccccacagtcatcgagatgcccttcggaggcaggagctatgacacagccagccgtgttgctgacaacccacgaacagacagacggagcaactctgcaccagactctcattcccaccgcgagtgggggtccacaagagggatccggcaatcagactttcatcacaagcagcggtatcacgtgcaccgattttgaggggttaaacgcactcatccaggaaggcaccgcagaggtgacggtggtcagcgacggtggccagaatattgctgtggctactacggcccctccagtgtttagcagtagcagtcagcaggagttgccgaaacagacatacagcataatccagggtgcggcacacccagccttgctgtgccccgctgacagtatcccggattag

SEQ ID NO: 25659 - DNA, 1938 bp, Artificial Sequence
  Description of Artificial Sequence: Synthetic coding sequence
atgaatgcctcgtctgaaggcgaatcattcgcgggatcagtccagatcccgggaggaacgaccgtgcttgtggaattgacccccgacatccatatttgcggaatttgtaagcagcaatttaacaacttagatgctttcgtggcgcataaacagtctggctgccagctgaccggaacgagcgccgcagcgcctagcactgtgcagttcgtttcggaggagacagtgcccgctacacagacgcagacaacaactagaacgatcacgagtgagactcagacgatcaccgtatccgccccagagtttgtgttcgaacacggctatcagacctaccttcctacagagtccaacgagaaccagaccgcgactgtcataagcctcccagcaaagagccggacaaagaaacccactacaccgcctgcgcaaaaacgactgaactgctgctatcccggatgtcagtttaagaccgcttatggaatgaaggacatggagcgccacctgaaaattcataccggcgataaaccgcacaagtgcgaagtttgtggaaaatgttttagcagaaaggacaaactgaagacacacatgagatgtcatacaggtgtcaagccatacaaatgcaaaacctgcgactacgcagccgctgattctagctctctgaacaagcaccttagaattcatagtgacgagaggccttttaagtgtcagatctgtccctatgcctcccggaattccagccagctgaccgtgcatcttcggtcacacacagcttctgagcttgatgatgacgtgcccaaagcaaattgcctctcgaccgagagcactgatactccaaaagccccagtgattacactgcccagtgaagcacgggaacaaatggcaacacttggcgaacgaactttcaattgttgttaccccggttgccattttaaaaccgtgcacggcatgaaggacctggaccgccaccttcggattcacacgggggataagccccataagtgtgagttttgcgataaatgctttagtaggaaagacaaccttacaatgcatatgcggtgccatacaagcgtgaagccgcacaagtgccacctatgtgattacgccgcagtggactcgtcctcccttaagaagcacttgcgcatacatagcgacgaaaggccctataaatgccagctgtgtccatatgcttcaagaaacagtagccaactgacagtacacctccgctctcataccggcgataccccttttcagtgttggctgtgcagcgcgaagttcaagatctcaagcgatctcaaaaggcatatgattgttcactcgggagagaagccattcaagtgcgaattttgcgacgtaaggtgtaccatgaaggcaaatctcaagtcccacatccggattaagcacacgtttaaatgcctgcattgcgcattccagggcagggatagagcagacctactcgagcacagcaggctgcaccaggcagaccacccagaaaaatgcccagaatgctcatacagttgctctagcgcggcagcgttacgagtacacagccgcgtgcactgtaaagatcgcccatttaagtgtgatttctgcagctttgatacaaaaaggccttctagcttagccaagcatgtcgacaaggtgcatcgagacgaggctaaaaccgaaaatcgcgcaccgctgggaaaggagggactgcgcgaaggctctagccagcacgttgcaaaaattgtgacacagagggcctttagatgtgagacatgcggagcttcatttgtgagagacgactccctgagatgtcataagaagcagcacagcgaccaatccgaaaacaagaattcagatctggtcactttcccccctgaatccggcgctagcgggcagttgtcaactctcgtcagcgtggggcagttggaagctcctctggaaccgagtcaggacctgtag

SEQ ID NO: 25660 - DNA, 2040 bp, Artificial Sequence
  Description of Artificial Sequence: Synthetic coding sequence
atgaacgcttcctcagaaggagaaagtttcgccggtagcgtgcaaagcgggaccactgtgctcgtggagctgacccctgatattcacatttgtggcatctgtaaacaacagtttaataatctggatgcctttgtggctcacaaacagtcgggctgtcagctgacagggacttctgccgctgcccctagcacggtacagttcgttagtgaggagaccgtcccagccacccaaacccagactacgactagaaccatcacctcagagactcagacgatcacggtttctgccccagagtttgtctttgaacacggataccagacatatcttccaaccgagtctaatgaaaaccaaacagccactgtcatcagtctgcctgcaaagtctcgtacaaaaaagcccaccacgccacccgctcagaagcgtttgaattgctgttaccctggatgccaattcaagactgcctacgggatgaaagatatggagagacacctgaaaatacatactggtgacaaaccccataagtgcgaggtgtgcggaaaatgtttttcaagaaaggataagctgaagactcacatgcgatgccacaccggtgtgaaaccgtacaagtgtaagacctgtgattacgcagccgctgacagcagcagtttaaacaaacaccttaggatacattctgacgaaaggccattcaagtgccaaatctgcccatatgcctctcggaactcatcccagctaactgtgcacctccgctctcataccggcgatgcccctttccagtgctggctctgcagcgcaaagttcaaaatctcgagcgatcttaagcggcacatgagggtgcattctggtgagaaaccttttaaatgtgaattctgcaatgtcagatgcacaatgaaggggaaccttaaatctcacattcgtatcaaacactccggaaataactttaagtgccctcattgtgatttcctcggcgattcaaaggccacgctgcgaaagcattcccgcgtgcatcaatccgagcatcccgagaaatgctctgagtgcagctattcctgttcctcaaaagcggctttacgcatccacgaacgtatccactgcactgataggccttttaaatgtaactactgcagttttgatacaaaacagcccagtaacctgtctaaacacatgaaaaagtttcatggtgacatggtgaagaccgaggctctggaacggaaggacaccggacggcagtcaagtcgacaagtggcaaaattggacgcaaagaagagcttccactgcgatatctgcgacgctagtttcatgagagaggatagcctgaggtcacacaagcgtcagcattctgagtactcggagtcaaaaaactcagacgttacggtgctgcagtttcagatcgacccttctaagcagcctgcgactcctctgaccgtcggccacctgcaggtgcccctccaaccgtcacaagttcctcaattctccgagggacgcgtgaagattatcgtcggacatcaggtaccccaggcgaataccatcgtacaggctgcagctgcggctgtgaacattgtaccaccggcacttgttgctcaaaatccagaggagctccccggtaatagcagactgcagatattgagacaggtgtccctgattgcccctccccagagttcacgatgcccaagtgaggccggtgcaatgacacagcctgctgtgctgcttactacccacgaacagaccgacggagcaactctgcatcagacgctaatccccacagcttcagggggaccccaggagggctccggcaaccagaccttcataacatcttctggtattacttgtacagactttgagggtctgaacgcactcatccaggagggcaccgcagaggtcaccgtggtttcagacggcggacagaacattgctgtcgccaccacagctcccccagtgttttcctccagttctcagcaggagctgcccaaacagacttacagcattatacagggagccgctcacccagccctgttgtgccccgcagatagtatccctgactag

SEQ ID NO: 25661 - DNA, 1932 bp, Artificial Sequence
  Description of Artificial Sequence: Synthetic coding sequence
atgaatgcgtctagtgagggggaatctttcgctggttctgtacagattcccggagggaccaccgtgctcgtggagctcacgcctgatatacacatttgcgggatctgcaaacagcagtttaacaatttggatgcttttgtagcacacaaacagagtggttgccagctaaccggaacatcagccgcagcacctagcacagtccaatttgtctcggaggaaactgtccccgcaactcagacgcagaccaccaccagaacgattacctctgaaacccagactatcactgtatctgcaccagaattcgtttttgaacatggttatcaaacctatctgcctacggagagtaacgagaatcaaaccgcaaccgtcatcagcttacccgcaaagagcaggacaaagaagcccaccaccccacctgcccagaagaggctgaattgctgctacccaggtaaaggaagcatcatgtcatatctttgtagaggcttaggaaggtacccaagcgagatcatatccgatgttcagaagtcctgcaagaattgtaccaaaaagaatagccccaatgtgacgatcctactgtacctgctgtgccacagcttatatatctacaagcttttacagtgcgtctttcccaaaaatcagaacattctcttaaataatcaccgtacgatcattaaaagcgactttgtgatcaaatgccacttcatgagctttatctcatctaaccaggaacagctgtccatctacctctcttttcgtttgtgcagtttcgggcgtaaccacaagatgactgtctgttttagccggagttctcatatcttcccaattaccgtcgtgcttaccctggtgacgtggctacgcatgtttttacctgtgttcagtatgttgaagttgagctttttcttcttagggtgccaattcaagaccgcctacgggatgaaagatatggaacgtcacctaaaaattcataccggcgacaagcctcataagtgtgaagtttgtgggaagtgcttttccaggaaggacaaacttaagacccacatgcggtgccacaccggagttaaaccctacaagtgcaagacttgcgattacgcagctgccgattcttcatccctcaataagcacctgcggatccatagtgacgagagacctttcaagtgccagatttgtccatacgccagcagaaattcctctcagctgacagtccatctccgaagtcatactggcgacgcaccctttcaatgttggttatgctccgccaaatttaagatctccagcgacctgaagagacacatgcgcgtgcactctggtgagaagcctttcaagtgtgagttttgcaacgtacggtgcactatgaaaggaaacctcaaatcacatatccggatcaaacattccggcaacaatttcaagtgcccccactgtgacttcctgggcgacagtaaggcgaccttgcggaagcacagccgcgtgcaccaaagcgagcaccctgagaagtgctctgagtgttcctacagttgctcttctaaagcagctctgcgaattcacgagcggattcactgtaccgaccgcccttttaagtgtaactattgcagctttgacactaaacagccatctaatctaagtaagcacatgaagaagtttcacggcgatatggtgaagaccgaggccctggagcggaaggacacaggtagacagtcttctaggcaggtcgccaaactagacgccaagaaatcatttcattgcgacatctgcgatgcctctttcatgagagaggactcgctcagaagccacaagagacaacattctgagtattccgagtcgaaaaactccgacgtgacagttttgcagttccaaatcgatccgtccaagcagcctgcaacaccattgacggtgggacacctgcaggtgccactgcagccatcacaggtgccgtag

SEQ ID NO: 25662 - DNA, 1281 bp, Artificial Sequence
  Description of Artificial Sequence: Synthetic coding sequence
atgtcacgcaggaagcaggcaaagccgcaacacttgaacagcgaggaacctcgacctgctcgcagggagtgtgcagaagtggccccacaggtggccggagagccggcttctgagcttgacgatgatgtgcctaaggcaaactgcttgagcactgaatcaaccgacacacccaaggcaccagtcatcacactcccatcagaggcacgtgaacagatggctacactgggggaaagaactttcaattgttgctacccaggttgccattttaaaactgtacacggcatgaaagatctggaccggcacctgcgaatccacaccggggataaaccacacaaatgcgagttttgcgataagtgtttcagccgaaaggataacttgacaatgcatatgaggtgccacacatcagtcaaaccccacaaatgccacctgtgcgattatgcagcagttgactctagctctctcaaaaagcatctccggatccactccgacgagcgcccatataagtgccagttatgtccttacgcttcaagaaactcctcccagctcacagttcacttgcgttcacacactggtgatactcccttccagtgctggctgtgttccgcgaagttcaaaatttcctccgacctgaagcggcacatgattgtgcacagtggtgagaaaccattcaaatgcgagttctgcgatgttcggtgtacaatgaaggccaacctgaaatctcacattaggatcaagcatactttcaagtgtctgcattgtgcattccagggacgcgatagggcagatctgctcgaacactcacgtctccaccaggctgatcaccctgagaaatgcccagagtgctcatactcctgttcctctgctgcggcattgcgagtgcactcaagagttcactgcaaggataggcctttcaaatgtgatttctgtagctttgataccaagcgccctagctctctcgccaagcacgtcgataaagtccaccgggatgaggccaagacggagaatagagcccctctgggtaaggagggcctgagagagggttctagccagcacgtagccaagatcgtaacccaaagggcatttaggtgtgaaacatgcggtgcttcttttgtccgtgacgactcgctccgctgtcacaagaaacagcatagtgatcagtccgagaacaagaactccgatcttgtcacttttccacctgaaagcggcgcatccggtcaattgtctacccttgtctcagttggtcaattagaggctcccctcgagccatctcaggacctgtag

SEQ ID NO: 25663 - DNA, 396 bp, Artificial Sequence
  Description of Artificial Sequence: Synthetic coding sequence
atgcgaggacatccatcactgcggcctccttggcattgggcctccgccgcacgactcgaaggaggatttcttccatgggggtatgtatccaatgccctcagtagagagggcttgacagaagagagaacgtttgaacggagacctgaaggctgggagggtgcctcttgtgccgcttctgagttggatgatgacgtgcctaaggcgaattgcctctctaccgagagtacagacacacctaaagcgccagtaatcacgctcccctcagaagctcgtgagcagatggcgactttgggcgaaaggacatttaactgctgttaccccggatgtcatttcaaaaccgtacacgggatgaaggacttagataggcatctgcgcatccataccgcttcctgttag

SEQ ID NO: 25664 - DNA, 666 bp, Artificial Sequence
  Description of Artificial Sequence: Synthetic coding sequence
atgaggggacacccatccctgaggccgccatggcattgggcttctgccgctcgattggaggggggttttctgccgtggggttacgtttctaatgctctaagtcgcgaggggttaactgaagaacgcacatttgagaggcgcccagagggttgggaaggtgctagctgcgctgcttccgagttggatgacgacgttcccaaagctaactgtttgtcaaccgagtctaccgacacccccaaggctcccgtcatcacgctgccatcagaggccagggaacagatggccacgctcggggagcgcacctttaattgttgctacccaggatgtcattttaaaaccgtgcatggaatgaaggatctggaccgccatctgaggattcatacaggcgacaagccacataaatgtgagttttgcgataagtgtttttccaggaaagacaatttgactatgcacatgagatgccacacatcggtgaagccacacaagtgtcacctgtgtgactacgctgctgtggatagttcatccctgaagaaacatctcagaatccatagcgacgagcgcccttacaaatgccagttgtgtccttacgcctcccggaattctagccagctgacagtgcacctcaggtctcacacaggagacacgcctttccagtgctggctgtag

SEQ ID NO: 25665 - DNA, 363 bp, Artificial Sequence
  Description of Artificial Sequence: Synthetic coding sequence
taggagcggacgttcaattgttgttatcctggttgccactttaaaactgtgcacggcatgaaagacttggaccggcatctccgcattcacaccggggacaagccgcacaagtgcgagttttgcgacaaatgtttctcaagaaaggataacctgactatgcacatgagatgccacacttccgtgaagccccataaatgtcacctctgcgattacgccgctgtcgactcctcttcgctcaaaaagcacttacgcattcatagtgacgaaagaccatacaagtgtcaactctgtccttatgcgagcaggaacagctctcagctaaccgtgcatctgcgatctcacacaggacccggacccggttag

SEQ ID NO: 25666 - DNA, 1572 bp, Artificial Sequence
  Description of Artificial Sequence: Synthetic coding sequence
atgaaggatatggagcgacatcttaagatacacaccggtgacaaacctcacaagtgtgaggtgtgcggaaagtgcttctctagaaaagacaagctgaaaacgcacatgcggtgtcacaccggcgtcaaaccctacaaatgtaagacatgtgactatgccgctgctgattcctcaagtcttaataaacacctgaggatacactccgatgagcggccttttaagtgtcagatttgcccttacgccagccgcaattcctcccagttaaccgtgcatttacggagtcacaccggagacgcgcctttccagtgctggctgtgctccgctaagttcaagattagctcagatctcaagcggcacatgcgtgtgcatagcggagagaaacccttcaagtgcgagttctgtaatgtgaggtgtacaatgaagggaaacctcaaaagccacatacgcataaaacactcaggtaataactttaagtgtccccactgcgacttcctcggcgacagcaaagccactttgcgaaagcattcacgggtccatcagagcgagcatcctgagaagtgcagcgagtgctcttactcttgttcctccaaggctgcactgcgtatccatgagaggatccattgcaccgatagaccgttcaaatgcaactattgctctttcgatacaaagcagccaagcaatctatcgaaacacatgaaaaaattccacggagatatggtgaagacagaagctctggaaaggaaagacaccggcagacagtcaagccgccaggtagctaagctcgacgccaaaaagagcttccactgcgatatttgcgatgctagttttatgagggaggatagcctcagaagtcacaaacgtcagcacagcgaatatagcgaaagcaaaaacagcgacgtcaccgtcttgcagtttcagatcgacccttcaaagcaaccggctaccccactcactgtaggacaccttcaggtacccctgcagccatcacaggttccacagttctcggaagggagggtcaagatcatcgtcggacaccaggtcccccaagcgaatactatcgtgcaagcagccgcagctgccgtgaacatcgtccctcctgccctagtcgctcaaaatcccgaagagttaccgggaaactctaggttacaaattctcaggcaggtttctctgattgcgccaccccagtctagtcggtgtcccagcgaagcaggggctatgacccagcctgccgtgttacttaccacccacgaacagaccgacggggctacactgcaccaaaccctcatcccaaccgcttccggcggaccccaagaaggcagcggaaaccagaccttcatcacctcatccgggatcacgtgtaccgatttcgaaggtctgaacgctcttatccaagaggggacagctgaagtgactgtggttagcgacggcggacagaatatcgctgtcgcgaccaccgcaccacctgtgttttcatcctcatcccagcaggagctgccaaaacagacatattcgattattcaaggcgctgctcacccagcgctgctttgtcccgctgattctattcccgattag

SEQ ID NO: 25667 - DNA, 1581 bp, Artificial Sequence
  Description of Artificial Sequence: Synthetic coding sequence
atgcctcagcagttactaatcacactaccaactgaggccagcacctgggtgaaacttcagcatcctaaaaaggccgtcgagggtgcccctctgtgggaagatgtgactaaaatgttcgagggcgaggcacttctcagccaagatgctgaagacgtgaaaacacagcgcgaaagcctggaagacgaagttactccaggccttcccactgcagagtcccaggagttgcttaccttcaaggacatcagcattgactttacccaagaggaatggggccaactcgccccagcccatcaaaatctgtacagggaggtgatgctggaaaactacagtaatctggtctctgtgggataccagttgtcgaaacctagtgtgattagtcagcttgaaaagggcgaagagccatggatggccgaaaaggaaggcccaggggaccctagctcagatttaaagagtaagatagagactatcgaaagtaccgccaaaagcactatcagtcaggagcgactataccatggcatcatgatggaatcattcatgcgcgacgacattatctattccacgctgcgcaaggtttcaacatacgacgatgttttggagcgccatcaggaaacctgcatgagagatgtcagacaggctatactaacccataagaagcgggtccaagagaccaataagtttggtgagaatattatcgttcacagtaacgttatcattgagcagcgacatcataagtacgacacacctacaaagcggaacacatacaaactggacttgatcaaccatccaaccagctacattaggactaagacatacgaatgtaacatttgtgaaaaaatctttaagcaacctatccacctcacagagcacatgaggatacacacaggggaaaagccattccggtgtaaagagtgcggccgagctttctcccaaagcgccagtctatctacccatcaaaggatacatactggcgaaaaaccttttgagtgcgaggagtgcggcaaggctttcagacatcgcagctcacttaatcagcaccaccggacccacaccggcgagaaaccttatgtatgcgacaagtgccagaaagccttttcccagaatataagcctcgtgcagcacttgcgcacacattccggggagaagccgttcacctgcaacgaatgcggaaaaacgtttcggcagattcggcacctctccgagcatatcaggatacacaccggggagaagccttacgcatgcacagcctgttgcaagacattttctcatcgcgcatacctgacccaccaccagcggatacacaccggggagcgcccatataagtgcaaagagtgtggcaaggccttccgtcagcgaattcacctctcgaaccacaagaccgtacataccggagtgaaagcctatgagtgcaaccggtgtggcaaagcgtacagacacgactcctccttcaaaaagcaccaacggcaccacaccggcgaaaagccctatgaatgcaacgaatgcgggaaggccttttcctataacagttctttaagtaggcaccacgaaatccatcgaaggaatgctttccgcaataaagtgtag

SEQ ID NO: 25668 - DNA, 1581 bp, Artificial Sequence
  Description of Artificial Sequence: Synthetic coding sequence
atgccccagcaactgctgatcacactgcccacagaagcctccacttgggttaaactgcagcacccaaagaaggccgtggagggagcccctctctgggaagacgtcacaaaaatgttcgagggtgaagcgctattaagccaggacgccgaggacgtgaagacccagcgtgagtccctggaagacgaagtcactcccggtcttccaacagccgagtctcaggagctgctgacattcaaagacatatcaattgatttcactcaggaagaatggggacaattagctcccgcacaccagaacctctatagagaagtcatgctggagaactactccaacctggtgagcgtcgggtatcagcttagcaaaccttctgtcatttcacagctggagaagggagaagagccttggatggccgaaaaagagggtcctggcgatccgtcttctgatcttaagtccaagattgagaccatcgagtcaactgccaagtctactatttcacaggaacgactctaccatggtatcatgatggagagtttcatgagggatgacataatttattcaaccttgcggaaggtctctacgtatgacgacgttctggaaaggcaccaggaaacctgcatgcgggatgtaaggcaggcgatcctgacccataaaaagcgggtccaagagacaaacaagtttggagaaaacataattgtgcactctaacgtaattattgagcagagacatcataagtacgatacccccactaaacgcaacacatataaactcgacctgattaaccaccccaccagttatatccgtaccaaaacctacgaatgcaatatctgcgaaaagatcttcaagcaacccatccatttgaccgaacatatgagaattcacacgggagagaagcccttccgatgtaaagagtgtggacgcgctttttctcagagcgcatctctaagcactcaccagcgcatccacacaggggagaaaccatttgagtgtgaagaatgcgggaaagctttccggcaccgctcatctctgaaccagcatcacagaacccatacgggcgaaaaaccgtatgtgtgtgataagtgccagaaagctttctcccagaacatctcccttgttcagcatctgcggactcactcgggagagaagccttttacctgcaacgagtgtggcaaaacttttaggcagatccgccatttatcagagcacatacgcatccatacaggagaaaagccatatgcttgtacagcgtgctgcaagacatttagccaccgtgcctacctcacccaccaccagcgtattcacacgggagaacgaccatataagtgtaaagagtgcgggaaagcatttagacaacgaatccacctgtctaatcataaaacagttcatacaggtgtgaaggcttacgagtgtaacaggtgtgggaaggcatacaggcacgattcttcttttaaaaagcatcagcggcaccatacgggcgagaagccctacgagtgtaacgagtgcgggaaggcattttcttataacagctctctgtcccgccaccatgaaatccataggagaaatgcttttcgcaataaagtgtag

SEQ ID NO: 25669 - DNA, 1299 bp, Artificial Sequence
  Description of Artificial Sequence: Synthetic coding sequence
atgcttgaaaactatggcaatctggtcagtgtggggtgccagcttagcaaacccggagtcattagtcagctcgagaagggggaagaaccatggctcatggagagagatatatccggtgtgccctcaagtgacctgaaaagcaagaccaagacaaaggagtccgcccttcagaatgacataagttgggaggaacttcactgcggactgatgatggagcggttcacaaaagggagctccatgtactccacgctggggaggatctccaagtgcaataaattagagagccagcaggaaaatcagcgtatggggaagggccagattcctttgatgtgtaagaagacatttacgcaggagagagggcaggagtctaacagatttgaaaagaggattaacgttaaatccgaagtgatgcctggaccaattggtctaccacggaagagggatcgcaaatacgatacaccaggcaagaggagtaggtacaacatcgacctcgtgaaccatagccggagctacactaagatgaaaactttcgaatgcaacatctgcgaaaagattttcaagcagctcatacacctcactgagcatatgcgcatccacactggagaaaagccctttcgctgtaaagagtgcggcaaagccttttcccagtcaagctcattaatccctcaccagcggatccatactggtgagaagccctacgagtgtaaggagtgcggtaagacgtttagacacccatcatcactcacccagcatgtgcggatccacacgggtgagaaaccctacgagtgccgcgtgtgtgaaaaggcatttagtcagtctatcgggttgatacagcacttgcggacccatgtccgcgagaagcccttcacatgtaaagactgcgggaaggctttcttccagatcagacatttgaggcaacacgagattatacacaccggcgttaagccatatatttgcaacgtttgcagcaagaccttctctcacagcacgtacctgacccagcatcaacgtacacatacaggcgaaagaccttacaagtgtaaagagtgcgggaaagcttttagccagcgaatacacctctcaatccaccagagggtgcacacaggcgtcaagccatacgaatgttctcactgcggcaaggcttttcggcacgattcttcttttgcgaagcatcagagaattcacaccggagagaaaccctacgattgcaatgaatgtggcaaagcattctcctgtagctcaagccttataaggcactgcaagacccacttgagaaataccttctccaacgttgtttag

SEQ ID NO: 25670 - DNA, 1605 bp, Artificial Sequence
  Description of Artificial Sequence: Synthetic coding sequence
atgctgcaacagctactcatcaccttacctacggaggcatctacttgggtaaagctaagacatcccaaggcggcaactgaaagggtagctctgtgggaagacgtgactaagatgttcaaagccgaagccctgctgagtcaggatgccgatgagactcagggagaatccctggaatctagagtgactctggggtctcttactgctgaaagccaggagttgctcacatttaaggacgtgtcggtagatttcacacaggaagaatggggccagctcgccccagcacacagaaacctttatagggaagtgatgctagaaaactatgggaacttggtctctgttgggtgtcagctcagcaaaccaggcgtgatttctcaattggagaagggagaggagccctggctgatggaacgagatatctccggtgttccttcatccgacctgaagtctaagaccaagactaaggaatctgcgttacagaacgatatttcctgggaggagttgcattgcgggctgatgatggagaggttcaccaaaggctcttctatgtactcaacactggggagaatatctaagtgcaacaagttggagtctcagcaggagaatcaacggatgggcaaaggtcagattccgctgatgtgcaagaagacttttacccaagaacgtggacaagagtctaataggttcgaaaaacgaatcaacgtgaagtcggaagtcatgcccggacccatcggattgccacgcaagcgcgataggaagtacgatactccaggaaaaagaagccgctacaatatcgatctcgtgaatcacagtcgaagctacactaaaatgaaaacgttcgagtgtaacatctgtgagaagattttcaaacaactgatacatctcacagaacatatgaggattcacaccggagaaaagcctttcaggtgcaaggaatgtgggaaagccttcagtcagtccagtagtctgatcccgcaccaaaggatccacaccggggagaaaccatacgagtgtaaggaatgtgggaagacctttaggcacccgagcagtctgacccaacacgtcaggatccatacaggggagaaaccgtacgaatgccgcgtctgtgagaaggccttctcacagtcaattggcctgattcagcaccttcggactcatgtgagagaaaagccatttacctgtaaagattgtgggaaggcgttcttccagatccgccacttacgtcagcacgagatcattcacacaggggtcaaaccatatatttgtaatgtttgtagcaagacctttagtcactcaacatatctgacacagcaccagcgaacccatactggtgaacggccttacaaatgcaaggagtgcggcaaagcatttagccaacggatccacctgtccatccaccaaagagtacacactggtgtgaaaccatatgagtgctcacactgcggcaaagcctttcgccacgattcatctttcgctaagcaccagaggatccatacgggagaaaagccttatgattgcaacgagtgcggcaaagctttctcatgttcttcatccctgattagacactgcaagacccaccttagaaatacgttttctaatgtggtgtag

SEQ ID NO: 25671 - DNA, 1398 bp, Artificial Sequence
  Description of Artificial Sequence: Synthetic coding sequence
atgttattttctgccctgttctttctcctttactccgctttcttcaggaggcccgagtatcagcgtaccattttcaagttccttgggtggttgtgcgatttgtcaatctattcattatttttccccattagtcgaatgtcggcgtttcagacttggcgcgacttcccagtcggggagcgcagaaggccttggctgatggaaagggatatctccggtgtcccatcttcagacctcaagagtaagaccaagacgaaggagagcgccctgcagaacgacatatcatgggaggagcttcactgcggattaatgatggagcgctttacaaagggaagctccatgtattctaccttgggacggatcagtaagtgcaataagctggagagccagcaggaaaaccaacgcatgggaaagggacagatcccactgatgtgtaaaaagacattcacccaagaacggggacaagaaagtaatagattcgagaaaaggatcaatgtcaaatcagaggtgatgcccggtcctatagggctacctcgcaaaagggaccgaaaatacgataccccaggcaagcggtctcgttataatattgatctggttaatcacagccgatcttacactaagatgaagacctttgaatgtaatatctgcgaaaagatatttaaacagttgatacacctgaccgagcacatgagaatccacacaggagaaaaaccatttaggtgtaaagagtgcgggaaggccttctcacagagttcctccctcattccacatcagcgaatccataccggtgagaaaccttatgaatgcaaagagtgtggcaaaacattcagacacccctcctccttaacacagcatgtccgcatccacaccggtgagaagccatacgaatgccgggtctgtgagaaagccttttcacaatccattggcttgattcaacacctaagaactcacgttcgagagaaaccattcacatgcaaggactgtggcaaggcctttttccagatccggcacctgcggcagcatgagatcatacacactggagttaagccttacatttgtaatgtgtgtagtaagactttctcccacagcacttatcttacccagcaccagcggactcacacaggggagcgcccttacaaatgcaaagaatgtgggaaggccttcagtcagcggatccacctgtctatacaccagcgggttcacacaggtgttaaaccttacgaatgtagccactgtgggaaggccttccgccacgatagctcctttgcgaagcatcagcggatccacacaggcgaaaagccatacgactgcaatgaatgcggcaaggcatttagctgtagtagctctctgatccggcactgcaagacccatctgcggaatacattttctaatgtggtctag

SEQ ID NO: 25672 - DNA, 5498 bp, Artificial Sequence
  Description of Artificial Sequence: Synthetic coding sequence
atggaggatacaccgccatctctttcctgcagtgattgtcagagacactttccatccctcccggagctctctcgacacagggaactgcttcatccctcacccaaccaggattccgaggaagccgactcgattcctcgaccttatcgctgccagcagtgtggcagagggtaccggcatccaggctccctggtgaaccaccggcgtacccacgagacaggactattcccctgcacaacctgtggcaaagacttctcaaacccaatggctttgaagtcccacatgaggactcacgctcctgaaggtagaaggcggcacagacccccacggccaaaggaagcaactcctcatctgcaaggagagactgtctccacagactcatgggggcagcggctgggttctagcgaaggatgggagaatcagactaagcatactgaggagactccagattgtgagtctgttcctgaccccagggccgcttcaggaacctgggaggacctgccgactcgtcaaagagaaggactcgctagccaccctggtcctgaggatggagcagacggctggggaccatcgaccaacagcgctcgagctccaccgttgcccattcctgcctcatctttgttgtccaacctggagcagtacctcgcagaatctgtggtgaattttaccggcggtcaagagcccacgcagagtcccccagcggaggaggagcgcagatacaagtgtagtcagtgtggcaagacatataagcacgccggttcactgacgaatcacaggcagtctcacaccctcggcatctatccatgtgctatctgtttcaaagagttttccaatttgatggccctcaaaaaccattctcgcctccacgcccaatatcgtccatatcactgccctcactgtcccagggttttccgtttaccacgggagctcctcgagcaccaacagtctcacgaaggagaaaggcaagagcccaggtgggaagagaagggcatgcccactaccaatggacatacagatgagtcatcccaggatcagctgccttccgctcaaatgctgaacgggtccgccgaactatccacctccggtgaattggaggattccgggctcgaggagtaccgtccatttcgatgtggagattgtggcaggacttatcgccacgcaggatctctgattaatcacagaaagtcacaccagaccggggtgtacccttgtagcctgtgcagcaaacagctctttaacgccgctgccttgaaaaatcacgtgcgagcacatcataggccgaggcagggggtgggtgaaaatggccaacccagtgttccacccgcaccactgttgcttgccgagacaacgcataaggaggaagaagatcctaccactaccttggatcatcggccatacaaatgctctgagtgcgggagagcctatagacacagaggctcattagtgaatcacaggcactcacataggacgggcgagtaccagtgtagcctgtgccctcgaaagtaccctaatctcatggccctacgtaaccacgtgcgcgtgcactgtaaggcagccagaagatccgctgatattggcgctgagggagctccctcacatcttaaagtagaacttcccccagaccccgtggaagcagaagcagctccacataccgaccaggatcacgtttgcaagcacgaggaggaggccacggacattacacctgcagccgataaaactgccgcacatatttgttccatttgcggtcttctgtttgaggacgccgaaagtctcgagagacatggcttgactcacggtgcaggagagaaagagaactcgcgcacagagacaacaatgtctccccctagagctttcgcgtgccgagattgtggcaaatcataccgacactcgggatcactcatcaatcaccggcagacccatcagaccggcgacttctcttgcggagcttgtgcgaagcacttccatacgatggcagcgatgaaaaaccaccttcgaagacattcaaggagaaggtcaaggaggcaccgaaagagggccggaggagcctctgggggaagagaagcgaagcttctggccgcagaaagttggactcgcgaactcgaggacaatgaggggctcgagagtccacaggacccctccggagagagtccacacggtgcagagggtaatctcgaatccgacggagattgtctgcaggctgaatccgagggtgataagtgtggcctcgagagagacgagacccacttccagggggacaaagaaagcggaggtacgggtgaaggcctggagaggaaggacgccagtctcctcgacaacctggacatccccggagaagaaggcggaggcacacatttttgcgactccctgacaggggtggatgaggatcagaagcctgctactggccaaccaaactcctcttcccattctgcaaatgccgtaactggttggcaggctggggctgcccacacctgtagcgattgcggccactcattcccacatgctacagggctgctgtcccaccgaccctgtcacccccctggaatataccaatgtagcctctgcccgaaggaatttgactccctccccgcactgcggagtcactttcagaatcaccggcctggagaggctaccagtgctcaacccttcctctgttgtctgtgtggaatgatctttcccggaagggccggataccggctgcaccggagacaggcgcattccagcagcggcatgaccgaggggagcgaggaggagggcgaggaggagggagtggcagaggctgcgccagctagaagcccccctctccaactgtctgaggcggagctgctgaaccaacttcagagagaggtagaggcactcgactccgctggatacgggcacatttgcggatgctgcggccaaacatacgatgatctcgggtctctggaaaggcaccaccagtcccaatcttctggaactactgcagacaaggccccaagtcccctgggcgtggctggagatgccatggaaatggtggttgatagtgtgttggaagacatcgtcaattccgtgtccggtgaaggaggagatgccaaatcccaggagggcgctggtacccctctgggtgactccctgtgtatccagggaggggaatctttactcgaggcgcaacctcggccatttcgctgtaaccagtgcggtaagacttatcggcatgggggatccctcgtgaaccaccggaagatccatcagacaggtgacttcctttgtccggtctgttctcgatgctatccaaacctggcagcgtataggaaccatttgcgaaatcatccccgatgtaagggatctgagccgcaggtgggaccaattcccgaggctgccggtagctccgagcttcaggtgggacctatcccagaagggggatctaacaagccccagcatatggctgaagaggggcctggtcaggccgaagttgagaagctccaggaagagctcaaggtggagccacttgaagaagtggctcgggttaaggaggaggtctgggaggagaccactgtcaaaggcgaagaaatcgagccgaggcttgaaactgcggagaagggatgtcagacagaagccagttcagagaggcccttcagttgtgaggtctgcggcaggtcctacaagcacgcaggaagtctcatcaaccatcggcagagtcatcagaccgggcacttcggctgccaggcgtgctcgaaaggattctctaatctcatgtcactcaaaaatcacagaagaattcatgccgatccaagaagatttcgctgctcggagtgtgggaaggcgttcagactcagaaagcagctggcgagccaccagcgggtacatatggagcggaggggaggaggcggaactcggaaagccactcgtgaagataggcccttccggtgcggccagtgtggacgcacataccgacatgccggatctctgctgaatcatagaaggtcacatgagacaggacagtactcttgtcccacatgcccaaaaacctacagcaatagaatggccttgaaagaccaccaacggctccacagcgagaaccgccgaagaagggccggtcggtcaagacgcactgcagtgcgatgcgcgctttgcgggagatccttcccaggcaggggcagcttggaacgacacctgagagaacacgaagagacggagagggagccggcaaatggtcaaggcggactggatggcactgccgcatccgaggccaacttgacaggtagtcagggcttggaaactcagctgggcggagccgaaccagtaccacacctggaagatggggttccacgtcccggagagcggtcacagagccccatccgagctgcctccagtgaagccccagaacctctaagctggggcgctgggaaggctggcggttggcccgtgggcggtggccttggtaaccattctggtggctgggtgccacaatttctgactcggtccgaggaacctgaagattcagtgcataggtcgccatgccatgctggcgattgccagctaaatgggcctaccttgtctcacatggacagttgggataacagagataactcctcgcaactccagcctggctctcattcctcctgttcccagtgcgggaagacttattgccagagcgggagcctcctgaatcataacacgaacaagaccgataggcattattgcctgctttgctctaaagagtttctcaatccagtggccacgaaatcgcatagccataatcatattgacgcgcaaacctttgcttgtcccgactgtgggaaagcctttgagtcccaccaagaacttgcctcacacctacaggcacacgctcgtggacattcacaggtacctgcccagatggaagaagcaagagatcctaaggccggaaccggggaagaccaggtagtgctgcccggacagggaaaagcccaggaggcacccagcgaaacaccccgtgggcctggtgagtccgtcgagcgtgctcgcggaggacaggccgtgacatctatggccgcagaagacaaggagcgccctttcaggtgtacgcaatgtgggaggtcctaccgccacgctggctccctccttaaccaccaaaaagcacatacgaccggactgtacccctgcagtttgtgccctaagctgctccctaatttgctatctctgaagaatcattctcgaacgcacactgatccaaaaaggcactgttgtagcatatgtggcaaagcatttcgcaccgccgctagactggaaggtcatgggcgtgtacatgcccctagagaaggtcccttcacatgtccccattgcccaaggcattttaggagacgtatctccttcgtccagcaccagcaacagcaccaggaggaatggacagtcgctggctccggtgccccagtcgccccagtgactggaaggggtgacctccccctgccaccacccccaaccccaaccacacccctactggatccatcaccgcagtggcctgcggatctgagcttctccctgta

SEQ ID NO: 25673 - DNA, 5489 bp, Artificial Sequence
  Description of Artificial Sequence: Synthetic coding sequence
atggaggatacccccccttctctgagttgcagcgattgtcagcgacattttccgagcttgccagaactgtcacgacaccgcgagctgctgcatccttctccaaaccaggattcggaggaagcagacagtataccgcgaccctaccgatgtcagcagtgtggcaggggctatcgacatcccggatccctagtaaatcatcgtagaacccacgagaccggcctcttcccgtgtacgacctgcggaaaggactttagcaaccccatggccctcaaatcccacatgagaacccacgccccagaggggcgtaggcgccaccgccctccaagaccaaaagaagctactccacacttacagggagagacagtcagcactgattcttggggccagaggctggggtccagcgagggatgggaaaatcagaccaagcataccgaggaaactcctgactgcgaaagcgtcccggaccccagagccgcaagcggcacttgggaagacctgccaacacgccaacgcgaaggccttgccagccatcctggcccagaggatggggcagatgggtggggcccttctaccaactctgctcgtgcgccacccctccccatccccgcttcttctttgttgagtaacttggagcaatacttagcggagtccgttgtgaatttcaccggagggcaggagcctacccagagtccgcctgccgaggaagaacgcagatataagtgttcacagtgcgggaaaacgtataaacacgctggttccctaacaaatcaccgccagagccacaccttaggcatctatccgtgtgcgatatgctttaaggaattttcaaacctcatggccttaaagaaccactcccgcctgcacgcccagtataggccatatcattgtccacactgccccagggtcttccgcttaccaagagaactactggaacatcagcagtcacacgagggggagcgccaagaaccgcgatgggaagagaaaggcatgcccacaaccaacgggcatactgatgaaagctcccaggaccagctgccatctgcccagatgttgaatgggagcgctgaacttagcacttccggtgagctcgaggattctggcctagaggaatatagacctttccggtgcggagactgtggcaggacgtatagacacgccggaagcttaataaatcacagaaaatctcaccaaaccggggtttacccctgcagcctgtgtagcaagcagctctttaatgccgcagcattgaagaaccacgtgagagctcaccatagaccacggcaaggggtcggagagaatggacagccgagtgtgccacccgcacctctgttgctggctgagacgacacacaaagaagaggaggacccaaccacgaccctcgatcatagaccttacaaatgctccgaatgtggacgggcttataggcaccgcggaagcctggtgaatcaccgccattcccaccgtactggagaataccagtgtagcctctgccccagaaaatatcctaacttgatggccctgaggaatcatgtgagggtacactgtaaagcggctcggcgaagtgccgatataggagcagagggcgctcccagccatcttaaggtggagctccctcccgatcccgtggaggccgaagccgctccccacacagatcaggaccacgtttgcaagcatgaggaggaagcaacagacatcacgccggcagcagacaagaccgccgcacacatatgcagtatttgcggcctgctgtttgaagacgccgaaagtcttgagagacatgggctgacacacggggcaggcgagaaagagaattctcggaccgagacaacaatgtccccgcctcgggctttcgcatgtcgagattgcggtaagtcatataggcattcagggtccctgatcaatcatcgccagacacaccagacgggggacttttcttgtggagcttgcgctaagcactttcacacaatggccgctatgaagaaccacctgaggcgtcatagccgacggaggtcccgcagacatcgcaaacgtgctggcggtgcgtccggcggaagggaagcaaaactcctggctgccgagtcgtggaccagagaattagaggacaatgagggtttggagtccccacaggatccctctggcgaaagcccccatggcgcagaaggaaatctggaaagtgatggtgattgcctccaggctgaaagcgaaggcgataaatgcgggcttgagagagatgaaacccacttccaaggcgacaaagagagcggcggtaccggcgaaggccttgagcgcaaggacgcatcccttctagacaatctcgatatccccggtgaagaagggggtggaacccatttctgcgattcactcactggcgtggatgaggaccagaaacccgctactggccagcccaactcctcctcacactctgcaaatgcagtgacaggatggcaggctggggctgctcacacctgctctgactgcggccacagttttccccacgcaacaggactcctgtcccaccgtccctgccatcccccaggtatctaccaatgcagcctgtgtcccaaggaattcgattctttgcctgcacttaggagtcattttcaaaaccacaggccgggagaggccacatcagcacaaccattcctttgctgtctgtgcggcatgatctttcctgggagagctgggtacaggctgcatcgcagacaagcacattcaagtagcggaatgaccgagggcagtgaggaggagggagaagaggaaggggtggctgaggctgccccagcccgatcaccaccactgcagttatcagaggctgaactcctcaatcagctgcaaagggaggtggaagcccttgattcagccggttatgggcatatctgtgggtgttgcgggcaaacttatgacgacctgggatctctggagagacaccatcagtctcagagctcgggaacaacagccgataaggcaccctctcctctgggcgtcgctggcgacgcaatggagatggtagttgattctgtgttagaggacatcgtgaattcagtgtcgggggaaggcggagatgccaaatcacaagagggtgccggaacacccctcggcgacagtctgtgcattcaagggggagagtccctactagaagcccagccacgacctttccgatgcaaccagtgcgggaagacctatagacatggcggttcgctcgtgaaccacagaaaaattcatcagaccggagactttctgtgtccagtgtgctcaaggtgttaccccaacctggccgcttacagaaaccacctcaggaatcaccctagatgcaaaggctccgagccacaggttggcccaatccctgaggccgcaggctcttctgaactccaggtgggacctataccagaggggggaagtaataagcctcagcatatggcagaagaaggaccaggtcaggcagaggtagaaaagctgcaagaggagctgaaagtggaacccttagaagaggtcgccagggtgaaagaggaagtctgggaggagactacagtcaagggggaagaaatcgaacccagacttgagaccgcagaaaagggctgccagaccgaggcctcctccgagcggcctttctcatgcgaggtttgcgggcgatcctacaaacacgcgggaagtctgatcaaccacaggcagtcccaccaaaccggccactttggatgtcaggcctgttcgaagggattttctaacctgatgtcactcaaaaaccaccggaggatccacgctgaccctcgtcgcttcagatgctcagagtgtggtaaggctttccgcctgaggaaacagctggcctcgcatcagcgagtccatatggaacgcaggggcggaggaggaaccaggaaagccactcgagaggacaggccctttcgctgcggccagtgcggcaggacgtaccggcatgcaggttccctgctgaaccataggaggagccatgaaaccggacagtacagctgtccaacatgtccgaagacatactccaatagaatggctctcaaagaccatcagcgtttacactcggaaaatcggcgtcgcagagctggcaggtcacggaggaccgccgtgagatgcgcgttgtgtggaagatccttcccaggcagagggagcctagagcgccatttaagggagcacgaggagacagagcgggaaccagccaatggacaggggggattggacggaacagcagcatctgaagctaacctaacgggctcccaggggctagaaacacagctgggcggagcggaaccagtgcctcacctcgaggatggagtcccaagacctggcgaaaggtcccagtctcctattagagccgcaagctcagaggcacccgagccgttgtcatggggtgcagggaaagccggtggatggcctgtaggaggcggactaggtaatcactcgggcggatgggtcccgcagttcctgacacgcagcgaggagccagaagacagtgtccacagaagcccttgccacgctggcgattgccagctgaacggtcctaccctctcacatatggactcttgggataaccgggacaactccagccaactgcagcctggttcccactcaagttgcagtcaatgcgggaaaacttattgtcagtcaggctcattgctcaaccacaataccaacaaaactgacagacattattgcctgctttgctctaaagaattcctaaatcccgtggccacaaaatcccactcacacaatcatatcgacgctcagacgtttgcctgcccagattgtggcaaagcctttgagagccaccaggaacttgcctcgcacttgcaggcccacgctaggggacattcccaagtgcctgcgcaaatggaggaagcgcgagatcccaaagcgggtacaggcgaggaccaagtggtgctccccggacaagggaaggcccaggaagcgccaagtgagacgcccaggggaccaggtgaatctgtagaacgggcaagggggggtcaggctgtgacatctatggccgctgaggacaaggagcgtcctttccgctgtacacagtgcgggaggtcctaccggcatgctggcagccttctgaatcaccagaaggcgcacactaccggcctgtacccttgctcactatgtcccaagcttttgcccaaccttttatcactgaaaaaccatagcagaacgcacactgaccccaaacgccattgctgttctatctgtggaaaagctttcaggactgctgcacggctggagggccacgggcgtgttcacgccccaagagaaggacctttcacctgcccgcattgtcccaggcatttcagacgtaggattagcttcgttcagcatcaacagcaacaccaagaggagtggacagtcgccggttcaggacgagggcacgagggctcgcaggaagaggtgggcactcagtggaggggtaagagcagtcctaaggtgggcggaggcgcaaggtctgaacgacgtgagccgaggggtttcta

SEQ ID NO: 25674 - DNA, 723 bp, Artificial Sequence
  Description of Artificial Sequence: Synthetic coding sequence
atggaggacacgccgcctagcctgtcatgctcggattgtcagcgacactttcctagtctcccggagctgtctcggcatcgcgagttgctgcaccctagtcccaatcaagatagcgaagaggccgatagcataccacgaccatacaggtgtcagcagtgcggtagaggctaccggcaccctgggagcctggtgaaccacagaagaacccacgagaccggtctgttcccctgcaccacatgtggaaaggacttttccaaccctatggccctcaaaagccatatgcggacacacgcccctgagggacgacgccgacaccgtcctcctcgccctaaagaggccaccccacatctgcagggagagacagtttctaccgattcctgggggcagagactcggtagctctgaaggatgggaaaaccagaccaagcataccgaagaaacgccagattgcgaatctgtgcccgacccaagagcggcttccggcacgtgggaagatttgcccacacgtcaaagagagggcttggccagccacccaggtcccgaggatggtgctgatgggtggggaccctctaccaatagtgcgagagcccctcctctgccaatccctgcgagttccctgctcagtaatctggagcagtacttggcagaaagtgtcgtgaattttaccggcggacaggaacccacacagagccccccagccgaggaggagcggcgatataagtag

SEQ ID NO: 25675 - DNA, 582 bp, Artificial Sequence
  Description of Artificial Sequence: Synthetic coding sequence
gagcgccgatataaatgttcacagtgcggaaagacctataagcacgcaggatcactgaccaaccatagacagtcccacactttgggaatctatccctgcgcaatctgcttcaaggaattttctaatcttatggcactgaaaaaccactcaagactccacgctcagtaccgtccttaccattgccctcactgcccgagagtttttcgactgccgagagagctcctggagcaccagcagtcccacgaggccgctcggccattttcttgtgaggtttgtggaaggtcttacaaacatgcaggctccctcatcaatcacaggcagtcccaccagaccggccatttcgggtgtcaggcgtgctcgaaggggttcagtaatctgatgtccctgaagaaccatcgcaggattcatgccgatcctcggagatttagatgctctgagtgtggaaaggccttccgactacggaaacagttagcaagccaccaaagggtgcacatggaaaggcacagaccattccgctgtggccagtgtggaagaacctatcgccacgccggaagcctcctgaatcatcggaggtcgcattag

SEQ ID NO: 25676 - DNA, 1707 bp, Artificial Sequence
  Description of Artificial Sequence: Synthetic coding sequence
atggcccaggtggattctcaggatagatggggcgaagccagtcccctatccagtctaacggaagaggcccacgatacccagatgctgagcatgaacctcgagtccgatgacgaggacggcggagaggcagagaaggaaggcaccgcagaccctgtcgcttgtcccaggggcagcagccccgtaacgcacgagaaccccgaccttccctggccccaccccttaggcaaggaggaggaaaagttttccgacagctctagcgctggtggtatgggacaaaagccggtggaaatgagcggtaaagccagctggagcagagacgtgacaaagattaacgagacccaagggtcacccggtgcttcccgcgctctcggatccctccccagcggcttggcacataaacttctgggccagatgcagccccttggcgatagattgcctgcaggcgacgacggatattctggcgcaaaccaggacgccgttcttgacgtccccccttcattccccagcaacggcaaatacctgtgcgcccataagagcgtggatactagcgctggcaatagctcgctcctctgtttccctcgtcccggttcaaattgggatctgcccacccaggaaacccacactcccgcacaggcctctgctacacctgcttcgctagccgcagctgttctcgctaaggctagaaatagtaggaaagtgcagaatcaggcgggtaggagggagggaggagaggctgaggcaaggccctatcgctgcctaaggggaggacgagcttttcagaagccatcgaaaccactgagtcctgccgaaacaaggggtggcgcagcaaagaggtacgcatgtgagctttgtggcaaggcgtattcgcatagggggacgttgcagcaacatagacggctgcatactggagagagaccgtaccagtgctcattttgtgacaaagcttacacgtggtctagcgatcatagaaaacatattcggacccatacgggtgagaagccatatccttgtcctgattgtggtaaagctttcgtgagatcttccgatctgcgaaagcaccagagaaatatgcattcaaataacaagcctttcccatgcagcgagtgcggactgacgtttaacaagcccttgagcttgctgcgtcatcagaggacacacttaggcgctaagccatttcgctgcccagcctgtgatcgtgaattcgcggttgcttccagaatggtcgagcatcagagggtgcacagtggtgagaggccctttccatgcccaacctgcggaaagtgtttcacaaagtccagcaatctgtcagagcatcagacactgcacaccgggcagagaccttttaagtgtgccgactgcggtgttgccttcgctcagcctagtagactcgttagacaccagcgaattcacaccggagagagaccctttccttgcacccagtgtggtcaggcattcgctcgtagctcaacgctcaagaggcaccagcagatccacagtggcgaaaagggattcttgtgtgccgagtgcggacgggctttccgcatcgcaagcgagctggcccagcatattaggatgcacaacggcgagagaccgtaccaatgcgaggattgcggtcaagcctttactcggtccaaccacctccagcgccatcgcgcaaagcacggcacatgtaagaaggagcccatcccgagttcttcagacgaatag

SEQ ID NO: 25677 - DNA, 1821 bp, Artificial Sequence
  Description of Artificial Sequence: Synthetic coding sequence
atgagccatacagcgtcatcgtgccaggaactggttgagaactgcgccgtgcacgtggcaggcatggctcaggaggacagcaggagagggcaggtgccgagctcattctaccatggcgcaaaccaggaactggatctttcaactaaagtttataagagggaatcaggatccccatactcagttctggtggatacaaagatgtctaagccccaccttcacgaaactgaggaacagccttacttccgcgaaacgagggccgtctccgatgttcatgcggtgaaagaagaccgcgaaaacagtgacgatacagaggaagaggaggaggaagtttcatataaacgggagcaaataatcgtcgaggtaaacttgaacaaccagaccctcaacgtctcaaaaggggaaaaaggagtctcgagccagtcaaaggaaactccagtgctcaaaacttcatctgaagaagaggaagaggaatcagaggaggaggctaccgacgactccaatgattacggggagaacgagaagcagaagaaaaaggagaagatagtggaaaaggtttcggtcacacaaagaagaactcgtcgcgcagctagtgtcgccgctgccacgacatctccaaccccacgcacaactcggggtcgacggaaatccgtggagcctcccaaaagaaaaaagcgtgccacaaaagaaccaaaagcacccgtccaaaaggcaaaatgcgaggagaaagagaccctaacttgcgagaaatgcccccgagtattcaacaccaggtggtacctggagaaacatatgaacgtcacccataggcggatgcagatttgtgataagtgtggcaaaaagttcgtgttagagtccgaattgtcattgcatcagcagacagattgcgaaaagaatattcagtgtgttagttgcaacaagtccttcaagaagctttggagcctacacgaacacatcaaaattgtgcacggatacgccgagaagaaatttagttgcgaaatatgcgagaagaagttttataccatggcccacgtgagaaaacacatggtcgctcacacgaaggatatgcccttcacctgtgagacctgtgggaagagcttcaaacgcagcatgagcctgaaggtgcatagcctgcagcactcgggtgagaaacctttccgctgcgagaattgtgatgagaggtttcagtataagtaccagctgagaagtcacatgagtatccacatcgggcacaagcagttcatgtgccagtggtgtggcaaagatttcaatatgaagcagtacttcgatgagcatatgaagacccatacaggcgaaaaaccctttatctgcgaaatttgcgggaagagctttacgagcaggcccaacatgaaacggcacagaagaacacataccggggagaaaccttatccatgcgatgtgtgcggccagcggttccggtttagcaatatgctgaaggctcacaaagaaaagtgctttcgggtgacctctcctgtcaatgtgccaccggctgtgcagatccccctgacaacaagtccggcaacccctgttccttctgtggtcaacaccgcaacaactccaacccccccaataaatatgaacccagtgagtactctcccgcctcgtcccatcccccacccgttcagtcacctgcacatccacccacacccccatcaccctcatcacctgcctatcccccctgtcccccacctaccacctcctccagccctgtttaaatccgagcctttaaaccatcgaggacagtccgaagataactttctgagacatctggcagagaagaatagctctgcgcagcatcattag

SEQ ID NO: 25678 - DNA, 1821 bp, Artificial Sequence
  Description of Artificial Sequence: Synthetic coding sequence
atgagtcatacagcatccagctgccaggaattggtggaaaactgcgcggtacacgtcgctgggatggcacaggaagatagtcggcgtggacaggtcccatccagcttttaccatggggctaaccaagaactggacctgagcactaaagtctataagcgagagagcggctcaccctactccgtcctagtggatactaagatgagcaagcctcatttacacgagaccgaagagcagccctattttcgagaaactagggcagtgtctgatgtgcacgccgtgaaagaagatcgggaaaacagtgacgatactgaagaggaagaagaggaagtttcctataaaagagaacagattatcgtcgaggttaatctgaacaatcagaccctgaatgtgagcaaaggcgagaaaggggtgtcgtcacagtcaaaagaaacacctgttctcaaaactagctcggaggaagaggaggaggagagcgaggaagaagcaacagacgatagtaatgattacggagaaaatgagaaacagaagaaaaaagagaagatagtggagaaagtgtcggtgacccagcgcaggacgagaagggccgcaagcgtggccgcagcaacaactagcccgactccgagaacgaccagagggaggcggaaaagcgtagaacccccaaagcgtaaaaagagagccactaaggaacccaaagcccctgtccaaaaggctaaatgcgaagagaaggagacactgacatgtgagaagtgccctagggtctttaacacccgctggtatttggagaaacacatgaacgtcacccacagaagaatgcagatttgcgacaagtgcgggaagaaatttgttctggaatctgagctctccctccatcagcagaccgactgtgaaaagaatatacagtgtgtttcctgtaacaagtcttttaaaaagttgtggagcctgcatgagcacatcaagattgtccacggatacgccgaaaagaaattctcatgcgaaatctgtgaaaaaaaattttataccatggcccacgtgcgcaaacatatggtggcccacacgaaagacatgccatttacctgcgaaacctgcgggaagagtttcaagcgatctatgagccttaaggtgcactctctgcagcacagtggcgaaaagccatttcggtgtgaaaactgcgatgaacgctttcagtacaaatatcagttgagaagccatatgagcatccacatagggcacaagcagttcatgtgtcaatggtgtgggaaggatttcaatatgaaacaatatttcgacgaacatatgaaaacacataccggggaaaagcccttcatttgcgagatttgtggtaagagttttacaagtcggcctaatatgaagcgccaccgacgaactcatacaggggagaagccatatccatgcgatgtgtgcggtcagcgcttcaggttctctaacatgctgaaagcacacaaagaaaaatgctttcgggtcacctcacccgtcaatgtaccacctgcagtgcagataccgctgacaactagcccggctaccccagtgccttctgttgtgaacactgccaccacccctacaccccctataaacatgaaccctgtgagtacgctgcctcccaggccaattccccaccctttttcacacctccatattcacccgcatccccatcacccacaccacttaccaatcccccctgttcctcatctgccccctcctcccgctcttttcaaaagcgaaccccttaaccatcgcggacagtcagaggataacttcctcaggcacctggccgagaagaatagttcagctcagcatcactag

SEQ ID NO: 25679 - DNA, 1281 bp, Artificial Sequence
  Description of Artificial Sequence: Synthetic coding sequence
atgtctcacacagcttcttcatgtcaggagttggtggagaattgtgcggtgcatgtggctgggatggcgcaggaggacagtagaagaggacaggtccccagcagcttttatcatggagctaaccaggaactggacctgtcgaccaaggtgtacaaaagagaatctggatccccttactctgtgctggtggatactaaaatgtctaagcctcacctccatgaaacagaagagcagccctacttcagagagacacgcgctgttagcgacgtccatgccgtcaaagaagatagagaaaactccgacgatacagaagaggaggaagaagaggtttcctataagcgtgaacaaattattgtcgaatgtgtaagttgtaataaatcatttaaaaagctgtggagccttcacgaacatatcaaaatagtccacggctacgcagaaaagaaattctcctgcgagatctgcgagaagaagttctatactatggcccatgtgagaaaacatatggtcgcacacaccaaggatatgccatttacctgcgaaacgtgcggcaaatcttttaagagatccatgtcactaaaagtccactccctgcagcattccggagaaaagcccttcagatgtgagaactgcgacgaacgcttccagtacaagtatcagctacggtcacacatgtcgatccacatcgggcacaagcaatttatgtgtcagtggtgtggaaaagacttcaatatgaagcagtacttcgacgagcacatgaaaacccataccggtgaaaagcctttcatctgtgaaatctgcggcaaatcctttacatcgaggcctaatatgaagagacatcgccgtacacacacaggagagaaaccatatccctgcgacgtttgtggacaacgatttagattttcaaacatgttgaaagcccacaaggagaagtgttttcgcgttacaagtcccgtcaatgtaccgcctgctgtgcaaattccactaacgacctccccagctactcccgtgccctctgtagttaatactgctaccacgcctaccccccctattaacatgaacccagtgtccacattaccaccccgtcccatcccacatccattcagtcacttgcatatccacccacacccccatcacccccaccatctccctatcccacctgtcccgcatctgccacccccaccagccctttttaagagcgagccgctcaatcatagagggcagtccgaggataatttcttgcggcacctcgccgaaaaaaactcctccgcgcagcatcactag

SEQ ID NO: 25680 - DNA, 1848 bp, Artificial Sequence
  Description of Artificial Sequence: Synthetic coding sequence
atggctgagcgcgctctcgaaccagaagcggaggcagaagccgaggcaggtgctgggggtgaagctgcagcggaggagggggcagccggtagaaaggccaggggacgcccacggctcaccgagagtgacagggccagacggagactggaatctagaaagaaatatgatgtgcggagagtgtacctcggggaggcccacgggccatgggttgatctacgcagacgatccggttggtcagacgcaaaattagcggcttacctaatcagcctggaaaggggccagcgctcaggaaggcacggaaaaccttgggaacaggtgcctaagaaaccgaaacgaaaaaagcgtcgcagacgcaatgtcaattgtcttaaaaacgttgtgatttggtacgaagatcacaaacacaggtgtccatacgagccccacctggccgagctcgaccccacgttcgggctgtacactacagctgtgtggcagtgcgaagcaggccaccgatactttcaagacctgcattctcccctgaagcccttgtcggactccgaccccgactccgacaaggtaggcaacggcttagttgcgggtagcagtgatagtagcagctctggttcggcatcagattctgaagaaagtcctgaaggccagccagtgaaagcagcagcagcagccgcagcagccacaccaacatctccagttggcagctccggcctaatcacgcaggagggtgtgcacatcccctttgatgtgcaccacgtggagtctctggcagagcagggcaccccactttgttccaaccccgctggcaatggtcccgaagctctcgaaaccgtggtatgtgtacctgtcccagtccaggtgggtgccggacccagtgcactgtttgagaatgtgccacaagaggctctcggagaagtcgtcgcatcatgccctatgcctggcatggttccaggtagtcaagtgattattatcgctggacctgggtatgatgcgctgaccgcagaaggcatacacttgaatatggccgcagggtccggcgtgccgggatccggcctgggagaggaggtgccttgtgcaatgatggagggagtagcagcatatacccagacagagccagaaggctcccagccatccacaatggatgctaccgccgtcgctggcattgagacaaagaaggaaaaggaggatctttgtcttcttaagaaagaggaaaaggaggagccagtggctcctgaactggccaccactgtgccagagtccgcagagcccgaggccgaagcagacggagaagaactggatggatctgacatgtcagcgattatctacgaaataccgaaagagcctgaaaagcgacgacggtctaaacgctctcgcgtgatggatgccgacggcttgttggagatgttccactgcccttacgagggctgttcacaggtttatgtggcactctctagtttccagaaccatgtgaacctggtgcaccgcaaggggaaaactaaagtctgtccacatccaggttgcggcaaaaaattttacctttctaatcacttgcgaaggcacatgatcattcatagcggcgtcagggagtttacctgcgagacgtgtggaaagagctttaaaaggaagaaccatctcgaggtgcatcgcaggacacatacaggtgaaacacctttacagtgcgaaatctgcgggtatcagtgccggcagcgggcttctctgaattggcatatgaagaagcacaccgcagaggtgcagtacaacttcacttgcgaccgctgtggaaaacgtttcgagaagctggatagcgtcaaatttcatacactcaagagccaccctgatcacaaaccgacttag

SEQ ID NO: 25681 - DNA, 1746 bp, Artificial Sequence
  Description of Artificial Sequence: Synthetic coding sequence
atgctatgtaacaaagagttcttgggagggcatattgtgcggcatgctcaagcccaccaaaaaaaaggaagcttcgcttgcgtgatttgcggcagaaagtttcgcaacaggggcctcatgcagaagcaccttaaaaatcacgttaaaaagatccagagacagcagattgctgcagcacagcaggatgatcaggaagttaccgctctggaagagatcaactgttcatctagctcaattagttttgagaatggtaattccgactcaaaggacctggaagttgaaacccttacagcttccagcgaagggaacaaagaggtgattcctgagcacgtggccgagtttattgagatcccaatcagtgttccggaggatgtaatagagaacgttatagaaaatggcagtccgaataatagtctgaacaacgtattcaaacccctgacagaatgcggggatgattatgaagaagaggaggatgaagagggggattatgaggaggatgactatgatctgaatcaggaaactagcgtgatccataagatcaacggcacagtgtgtcacccaaaggatatatacgccacagatcaggaggggaatttcaaatgccctgccttgggttgtgtcagaatattcaagcgtatcggattcctgaacaagcacgcaatgaccgtgcatcccacggacctcaacgtgcgccagacggtcatgaagtggtctaaaggcaaatgcaagttttgtcagcgccagttcgaggatagccaacacttcattgaccacctgaaccgccattcttatccaaatgtttatttttgcctgcactttaattgcaacgaatctttcaagctgccttttcagctagctcagcacaccaagtcccaccgcatattccaggcccagtgctccttcccggagtgtcacgagctctttgaggatctccctctcctgtacgaacatgaagctcagcattaccttagcaagactccagagagttctgcacaaccaagcgaaaccattctttgggatgtgcagactgactctaacccgaaccaggagaaggactcaagcagtaatgagaaacagaccatttcattaccagtctctacctccaaatccagaaaagagagcactgaaccaaaaacatgcatagaaagcatggaaaaaaagaccgactcccttgtacagaatggtaatgaaagatcagacgatacggtttctaacattagcctcatcgaccagaaaatgccagatatcgagcctaattctgaaaacaactgcagcagctccgatatcgtgaacggtcactcggagatcgaacagacgccactggtgagctctgaccctgcattgaaaatcgacactaatcggattagaaccgagaacggaagcatcctgccctccgtcgtgccgcaagaacacaacacgttaccggtctcccaggcaccttccaaacctaacctgacctcagaacatacaagttacggactgatattgaccaaaccgtacgtgagacccttacccccttcatatttggatgagagatatcttagcatgccaaagcggagaaagtttcttacggatcgcgtagatgcttgctccgatcaagacaacgtgtacaaaaaaagtgtcaagagactgcgttgtggcaaatgcttgactacgtattgcaacgctgaggctctggaggcccatctggcccagaaaaaatgccagacactgttcggctttgacagcgatgacgaatccgcgtag

SEQ ID NO: 25682 - DNA, 3180 bp, Artificial Sequence
  Description of Artificial Sequence: Synthetic coding sequence
atgaacatgagccaggcatcagtctcctttcaagacgtgactgtagagttcactcgagaggagtggcagcacctgggtccagtggagcggaccctgtaccgtgatgtaatgctggagaattattcccatctgatctctgttggatattgtatcaccaaaccgaaagtaatctctaaacttgagaagggggaagaaccttggagcttggaagatgaatttctcaaccagcggtatcccggttacttcaaggtggaccatatcaaaggcattagggaaaagcaggaaaagccactgtggcaggagatttttatttcggacgccgacaaaaccctctctaaagagggacagaaggtgctggaaaaaccatttaatctcgagatcgccccagaactgtctgagaagattagttgcaagtgtgattctcaccggatgaacttgcctgtcgccagccagttgataatatcggaaagaaagtactctagaaaaaaaaccgaatatatgaatgtttgcgagaaactccagttagatattaaacacgagaaggcccacgccgaggaaaagtcctacgagcatggtgagaacgccaaggcattttcatacaagaaggaccagcactggaaattccagactcttgaagaaagcttcgagtgtgatggcagtggccaggggttgtacgataaaaccatctgtatcaccccacagagtttcctaaccggggaaaagagctgcaaagacgacgaattccgcaagaatttcgataaaattaccctgtttaatcatatgcgcaccgacacaagagggaagtgcagcgatttgaacgaatatgggacttcctgtgataaaacgacagctgtcgaatacaacaaagtacacatggcgatgactcactacgaatgcaacgagcggggtattaacttttcgcgtaaatctcccttgactcaaagtcagaggacaatcactggctggagcgcattcgaaagcaataaatgtgaggaaaatttctctcagtcatcggctcacattgtgcaccagaagacacaggccggagacaagtttggcgaacacaacgagtgcaccgacgcactctaccagaagctagatttcaccgcacaccaacgcattcatacagaggacaagttttacctaagtgatgagcacgggaagtgccggaagagtttctaccgcaaggcgcatctgatacagcaccagagacctcacagcggcgagaagacctaccagtacgaagaatgcgctaaaagtttctgtagtagctcgcatcctatacaacacccagggacatacgtgggcttcaaactatacgaatgtaacgagtgcggcaaggcgttttgccagaacagcaatttgagcaaacacctgagaatccacaccaaggagaaaccgtgcgacaacaatggctgcggacgttcatacaaatctcccctgataggccatcagaagactgacgccgagatggaactgtgtgggggttcagaatacggaaagacgtctcacctaaaaggtcaccagcgaatcttgatgggagaaaaaccctatgagtgtattgagtgcggtaagactttttccaagactagtcatctgagagcacatcagcggatccataccggcgaaaaaccatacgagtgcgtggagtgtgagaagaccttttcgcacaaaactcaccttagtgtacatcaacgagtgcacaccggcgagaaaccctatgagtgtaacgactgtgggaagagctttacctataatagcgctctcagggcgcatcaaaggatccacacaggagagaagccatacgaatgctcggattgcgagaagacatttgctcacaacagcgccctgcgcgctcaccatagaatccatacaggcgaaaagccttacgagtgcaacgagtgcggtagaagtttcgcacacatatccgtgctaaaggcccaccaacggattcataccggtgaaaaaccctatgaatgcaacgagtgtggacggagctttacatacaactccgcactgcgagcacatcagcgtattcatacggggcgaaagccttacgagtgttcagattgcgagaagacattcgcccataacagcgctcttaaaatccatcagagaatacacaccggagaaaagccttacgaatgtaatgaatgcgagaagaccttcgcccacaactctgccctgagggcccaccagaatatccatacaggcgaaaagctttacgaatgtagtgaatgtggtaaaacctttttccaaaaaacaagactttcaacccaccggaggattcatactggcgagaaaccttatgaatgtagcaagtgcggcaagacattctctcagaagtcttacctgtcaggccatgagagaatccataccggcgaaaagccgtatgaatgtaacgtctgtggtaagactttcgtctacaaggccgcattgatcgtgcatcagagaatccacactggtgaaaagccttacgaatgcaatcagtgtggaaaaacgttctctcagcgcacccatttgtgtgctcaccaacgaattcacaccggggaaaaaccatacgaatgcaatgagtgtggaaaaacatttgccgataactcagctcttagggcccaccatcgtatccatacgggagagaaaccctatgagtgcaatgactgcggcaaaacattttcgaagacgagccacctacgggcacatctccggacccggagcggagaaaaaccttacgagtgttccgagtgtggtaagaccttttccgagaagagctacgtgtcggcccaccaacgcgtacacaccggcgagaagccctatgagtgcaatgtgtgcggaaaaccgtttgcccacaactctacgttgagggttcatcagcggatccataccggcgaaaaatcttatgagtgcaacgactgcggcaagacattctcacagaagagccacctctcagcacaccagcgcatccatactggcgagaagccctatgaatgcaatgagtgtgggaaagcttttgctcaaaattccacactgagagtgcaccagaggattcacaccggcgagaagccgtatgagtgtgacgaatgtggaaagacatttgttagaaaagcagccttgagagttcatcacacccggatgcatacccgagagaaaacgctcgcatgcaacggcttcggaaaatcatag

SEQ ID NO: 25683 - DNA, 1848 bp, Artificial Sequence
  Description of Artificial Sequence: Synthetic coding sequence
atgagtcaggcctcagtttcatttcaagacgtgactgttgaatttacacgagaggaatggcagcatctcggcccagtcgagcggaccctgtatagggacgtgatgctcgagaattatagccacctaattagcgtggggtattgcattactaaacccaaagttatttcaaaactggaaaagggggaagagccttggtctctggaggacgagttcctgaatcagcgttaccccggttatttcaaggtggatcatatcaaggggattcgtgagaagcaggagaagcctttatggcaggagatattcatttctgatgccgataaaaccctgtccaaggagggtcaaaaggtcctggagaaaccttttaacctcgagattgccccagaactgtcagagaagatatcgtgtaagtgtgacagtcacaggatgaacctccccgtggcttctcagctaatcattagtgaacgcaagtacagccgaaagaagactgaatacatgaatgtgtgtgagaagctgcagctggacattaagcatgagaaggcacacgccgaggagaaaagttatgagcacggggaaaatgccaaggcattttcatacaaaaaggaccagcactggaaattccagacactggaggagagctttgaatgcgatgggtcaggccaagggctttatgataagaccatttgcattactcctcagtcattcctgaccggagaaaagagctgtaaggatgacgaatttaggaagaatttcgacaagatcaccctttttaatcacatgcggaccgacacccgaggaaagtgttccgacctgaatgaatatggaactagctgtgataaaaccactgccgtggagtacaataaggtgcacatggctatgactcactacgagtgcaacgaaaggggaatcaattttagtcgaaagtcgccattgactcagtcacagcggaccattacaggctggagcgcttttgagagcaataagtgtgaggagaacttttctcagtccagtgcacacattgtccatcagaaaacacaagcaggtgataagtttggtgaacataatgaatgtacagatgccttataccagaagctggactttacggcccatcagaggatccacacagaagacaagttttatttatcagacgagcatggaaaatgccgtaagtctttttacaggaaggcgcatctgattcagcatcagcgtccccacagtggcgagaaaacatatcagtacgaagaatgtgcaaagagcttttgttcctcttcacatcccatccaacacccaggcacatatgtgggatttaagctgtacgagtgcaacgagtgtggcaaagccttttgtcagaactctaacctgtccaaacatctgaggatacacactaaggagaaaccttgcgataacaacggctgtggaaggtcctataagtcccctctcattgggcaccagaagacagacgccgaaatggaactctgcggcggtagtgaatatggaaaaaccagtcatctaaagggtcatcagcggattctaatgggtgaaaaaccttatgagtgtatcgagtgcggcaaaaccttctcaaagacttcccatcttagggcccatcagcggattcatacaggggaaaagccctatgagtgcgtggagtgtgagaaaacattttctcataagactcacctatccgtgcatcagagagtgcacaccggggagaagccctacgagtgtaatgattgcggaaaaagcttcacatacaattcagccttgcgcgctcatcagagaatccacaccgggctggccgtatgccatgtgggcatactgatggcaactaaatctttgtttcaccagagctag

SEQ ID NO: 25684 - DNA, 996 bp, Artificial Sequence
  Description of Artificial Sequence: Synthetic coding sequence
atgcgtaggaaaacacggaacttcaaacacaagacagtaaaggataataaagttctgacagagggctcagatcaggagtccgaaaaagacaacagccagtgctgtgaccccgctactaatgagcgcgttcaagccgagaaaaggcaatatgtgtgcaccgaatgcggcaaggccttctcacaatctgccaacctgacagtgcacgagcgtattcacacgggtgagaaaccctacaaatgcaaggagtgtggaaaagctttcagccattcttcaaatctggtggtacatcgtaggatccacacgggactaaaaccttatacttgctctgagtgcggcaagtcgttttccggtaaatcacatctcattaggcatcaaggaatccactccggagaaaagacctatgaatgcaaggagtgtggaaaagcattctctcgctcgagcgggctgatatcacaccaccgtgtgcatactggagagaagccatactcctgcatcgagtgcggaaaggcattttcaagatcctctaatctcacacagcatcagcgaatgcatcggggtaaaaaggtgtacaagtgcaaagagtgcggaaaaacgtgcggctcaaacactaaaatcatggaccaccagcggattcataccggggagaagccttacgagtgcgacgagtgtgggaagacgttcattctacggaagactctgaatgagcatcaaagactgcatcgtcgggagaaaccatataaatgcaacgagtgcggcaaggcctttacttccaaccggaatctggtggatcaccagcgagtgcacacaggcgagaagccatacaagtgcaatgagtgcggaaagacttttagacaaacttcccaggttattttgcacctccggacacacacgaaagaaaagccgtacaagtgctctgagtgcggtaaagcatacaggtactcctcccagttaatccagcaccaacggaaacacaacgaagaaaaggaaaccagttag

SEQ ID NO: 25685 - DNA, 120 bp, Artificial Sequence
  Description of Artificial Sequence: Synthetic coding sequence
atgagaagaaagacgcgcaactttaaacacaagacggtgaaagacaataaggtcctgaccgaggggagcgatcaggaatccgagaaggataactctcaatgttgtgaccccgctacgtag

SEQ ID NO: 25686 - DNA, 105 bp, Artificial Sequence
  Description of Artificial Sequence: Synthetic coding sequence
atgagaagaaagaccaggaactttaaacacaagaccgtcaaagacaacaaggtgctgacagagggatctgaccaagagagcgagaaagacaatagccagtgttag

SEQ ID NO: 25687 - DNA, 1359 bp, Artificial Sequence
  Description of Artificial Sequence: Synthetic coding sequence
atggctgctgtcgctttagcctccggaacacggcttgggttagtgctggagcttttgccagggcagccagctctcccgcgagctcgacgcgagtccgttactttcgaagatgtcgcggtgtacttctctgagaatgaatggataggcttgggacctgctcaaagagccctctatagggacgttatgctggaaaattatggcgctgtggcctctttagccttccccttccccaagcccgctctgataagccagttggagcggggagaaactccctggtgctctgttccccgtggagctttagacggcgaggctccacgagggatttcaagcgagggcgtgctgaaaaggaagaaagaggactttatactgaaagaagaaatcatcgaggaggcccaggacctgatggtcctgagtagcgggccacagtggtgtggcagtcaggagttgtggtttggcaagacctgtgaagagaagtcccgtcttggccgatggccaggatacctgaacgggggacgtatggagagctccactaatgacatcatagaggttattgtgaaagacgaaatgataagtgtggaagagagctccgggaacacggacgtgaataacctcttaggcatccaccacaaaatactcaacgagcagattttctatatctgtgaagagtgtgggaagtgcttcgatcagaatgaagactttgatcaacaccagaaaactcataacggggaaaaagtctacggctgtaaggaatgtggcaaggcattttctttccggagccattgcattgcacatcagcgcattcatagcggcgtgaagccctacgagtgccaggagtgtgccaaagcttttgtctggaaatcgaacctcattaggcaccaacgtatacacacaggggaaaagccttttgaatgcaaggagtgcggaaagggcttcagtcagaacacttcactgacgcagcatcagcgaatacatactggtgaaaaaccctacacatgtaaagaatgcgggaagagcttcactcgaaacccagccctcctgcgacaccagcggatgcatacgggggaaaagccttatgagtgtaaggattgtgggaaggggtttatgtggaactctgatctttcccagcatcagcgtgttcacaccggtgataaaccccacgagtgcacagattgtggaaaaagcttcttttgtaaggctcacctgatccggcaccagaggattcataccggcgagagaccttacaaatgcaacgattgcggcaaagcattttctcagaactccgtactgatcaagcaccagcggcgacacgctcgggataaaccttacaactgccagatctcccacttgctggaacactag

SEQ ID NO: 25688 - DNA, 1281 bp, Artificial Sequence
  Description of Artificial Sequence: Synthetic coding sequence
atgctggaaaattatggggctgtggcctctctcgcagcatttccctttccgaagcccgctctcattagtcaactcgagcgcggtgaaaccccttggtgcagtgttccgcgtggagcactcgacggtgaggcacccagaggcatcagttctggctacccattcctgaaacctgccggtatttcacaccccgaacaggtggaagaacctctgaacttaaagctgcagggcgagggacctagcctgatttgccctgaaggtgtccttaagcgcaaaaaagaagattttattctgaaagaagaaatcattgaggaggcccaggatctcatggttctcagtagcggaccacagtggtgtggttctcaggagttgtggttcggcaagacatgtgaagaaaaaagtagactcgggcgttggccgggatacttgaatggtggcaggatggagagtagtaccaatgacataattgaagttattgtgaaggacgaaatgatctccgttgaggagtcaagcggaaataccgacgtgaacaatctcctgggaattcaccataagattcttaacgagcagattttctacatctgtgaggaatgcggaaagtgctttgatcaaaatgaagattttgaccaacatcagaagacacataacggcgaaaaagtatacggttgtaaagaatgcggtaaggctttcagttttcggtcacattgcatagctcaccagcgcatccactccggggtgaaaccatacgagtgccaagaatgcgcgaaggcattcgtctggaagagtaacctgatccgccaccagcgtattcacactggggagaaacccttcgagtgtaaggagtgtggaaaaggtttttcccaaaacacttcgttgacacagcatcagaggattcatactggagaaaaaccctatacttgtaaagaatgtggaaagagcttcaccaggaatcccgcactgttaaggcaccagcggatgcataccggtgaaaaaccttacgagtgtaaggattgtggtaagggcttcatgtggaattccgacctctcacagcaccagagagtacataccggggataagccccacgaatgtacagattgtggaaagtccttcttctgcaaagcccatctgatacggcaccagcggattcacaccggcgagagaccgtacaaatgtaatgactgcggaaaggcgttctcgcagaacagcgtgctgattaagcatcaaagaaggcacgcgagggacaagccctataactgtcagattagtcatctgctggagcactag

SEQ ID NO: 25689 - DNA, 1281 bp, Artificial Sequence
  Description of Artificial Sequence: Synthetic coding sequence
atgctggaaaactatggagctgtcgcatctctggctgcctttcccttccccaagcccgcactaatttcccaactggaacggggagagaccccctggtgttcagtacctagaggcgcactcgatggagaagccccaagaggcatctcaagcgggtatcccttccttaagcctgctggaatctcccatcctgaacaagtggaagaacctcttaatttaaaactgcagggggaggggccttctttaatttgtccggagggggtgttaaagaggaagaaagaggattttatcctgaaggaagagatcatcgaagaggcgcaagatcttatggtcctgagttccggcccacagtggtgtggaagtcaggaactatggttcggcaagacctgcgaggaaaagtctagactcgggcgatggcccggatatctcaatggtgggagaatggaaagtagtacaaacgacataatagaggtaatcgtgaaggatgagatgattagtgtcgaggagagcagcggcaacaccgatgtgaacaaccttctgggcattcaccataagattctgaatgagcaaattttttatatctgcgaggagtgcggtaagtgttttgaccagaatgaggacttcgatcagcatcaaaagacccataatggggaaaaagtctatgggtgtaaggagtgtggaaaggccttctcatttaggtcccactgcatcgctcaccaaaggatacactctggggtgaaaccttatgagtgtcaggagtgcgccaaagcctttgtgtggaaatccaacctgatacgacaccagaggatccataccggcgagaaacctttcgagtgcaaggagtgcggaaaaggcttctcccaaaacactagtctcactcaacaccagcggattcatactggcgagaagccttacacatgcaaagaatgcggaaaaagtttcacaaggaaccccgctctgctgaggcatcaacgcatgcataccggtgaaaaaccttacgaatgcaaggactgcggcaagggcttcatgtggaattccgacctgagtcagcaccagcgggtccacactggcgacaaacctcacgagtgcactgattgtggcaaatctttcttctgcaaagcccacctcattaggcaccagcggatccatacgggtgagcgaccctacaagtgtaatgattgcgggaaggccttttctcagaacagcgtgctgattaagcatcagcgccgacacgccagagacaaaccctacaattgccagataagtcatctcctcgaacattag

SEQ ID NO: 25690 - DNA, 786 bp, Artificial Sequence
  Description of Artificial Sequence: Synthetic coding sequence
atgatctacaagtgtcctatgtgtcgcgaatttttttcagaacgggcagatcttttcatgcaccagaagatccataccgcagagaaaccacacaaatgcgacaaatgtgacaaaggattcttccacatcagtgagctgcacatccactggcgggaccataccggtgagaaggtatacaaatgtgacgattgcggcaaagactttagcactaccacaaagctcaataggcacaaaaaaatacacaccgtagaaaagccatacaagtgttacgagtgtgggaaagcatttaattggtcatcccacttgcaaatccacatgcgggtccataccggcgaaaagccgtatgtgtgcagcgaatgtggccgaggcttttctaacagttctaacctgtgtatgcaccagcgcgtgcacaccggggagaagccattcaagtgcgaggagtgcgggaaggcattccggcacacaagctcactctgcatgcaccaaagggtgcatactggtgagaagccttataaatgttatgaatgtgggaaagctttcagtcagtctagtagcctctgtatccaccagcgcgtccataccggggaaaagccctatcggtgttgcgggtgtggcaaggcattttctcagagctcaagcctgtgcattcatcagcgggtacacacaggcgagaagcccttcaagtgcgatgaatgcgggaaagccttctcccagagcacaagtctttgcatacaccagagggtgcatactaaggagcgaaaccatctgaagatatccgtgatttag

SEQ ID NO: 25691 - DNA, 786 bp, Artificial Sequence
  Description of Artificial Sequence: Synthetic coding sequence
atgatatataagtgtccaatgtgtcgcgagtttttctcagagagagcggacctgtttatgcaccagaaaatccatacagccgagaagcctcacaaatgtgataaatgtgacaagggcttctttcatattagcgagttgcacattcattggagagaccacactggggagaaagtgtacaagtgtgatgattgtgggaaggatttctcgactacaaccaagctcaaccgccataaaaagattcacactgttgagaaaccttacaagtgctacgagtgcggcaaggcatttaattggagctcacatctgcagattcacatgcgggtacacacaggggagaagccctatgtttgctctgaatgcggcagaggattctctaatagcagcaatctgtgtatgcaccaacgcgtgcataccggagagaaaccgttcaaatgcgaggagtgcggtaaggcgttccgacacacaagttccttgtgcatgcatcagagggtgcacacaggggagaaaccctataagtgctatgagtgtggaaaagctttctctcagagcagctctctgtgtatccatcaaagagtgcacaccggagaaaaaccttaccgctgttgtggctgcggcaaggcattctctcagagctccagcctatgcattcaccaaagggtacacacaggggagaagccatttaagtgtgatgagtgtggcaaggccttttctcagtcaacgtccctgtgtatccatcagagagtgcacaccaaggagcgcaaccacctcaagatctcagtaatttag

SEQ ID NO: 25692 - DNA, 600 bp, Artificial Sequence
  Description of Artificial Sequence: Synthetic coding sequence
atgattgttgtgagaatattagccctccagcagaacctgattgatatccggaagtcaacacagtggcggtctcctatcaacgtaacatctggcaaggccttcaattggtcaagtcacctccaaattcatatgcgagtgcataccggcgaaaagccgtatgtgtgtagtgagtgcggccgaggcttcagcaactccagtaatctctgtatgcatcaaagagtacatacaggagagaagcccttcaagtgcgaagagtgcggtaaagcgtttcgccatacaagtagtctgtgtatgcatcaacgggtgcataccggtgagaaaccctacaagtgctatgaatgtggcaaggctttctctcaaagctcctccctgtgcatccaccaacgcgtgcacaccggcgagaaaccgtatcgttgttgcggttgcggaaaagcctttagtcagtcgtcttcactgtgcatccatcagagagtgcatactggggagaaaccttttaagtgtgacgagtgcggtaaggcgttttcccagtccactagcctttgtatacatcaacgcgtgcacacgaaggagagaaatcacctgaagatctccgttatctag

SEQ ID NO: 25693 - DNA, 786 bp, Artificial Sequence
  Description of Artificial Sequence: Synthetic coding sequence
atgatctataaatgtcccatgtgcagggagttttttagcgaacgggctgatctgttcatgcaccagaagatccataccgctgaaaagcctcacaagtgcgacaagtgtgataaaggcttttttcatatctccgaactacacatacattggcgcgaccacacaggcgaaaaagtctataagtgcgacgactgcgggaaggacttttctactaccaccaaactgaatagacacaagaaaatacacacggttgaaaaaccttacaaatgttacgaatgcggaaaagccttcaactggagcagccacctgcaaattcacatgcgcgtccatacaggtgaaaagccttatgtgtgtagtgagtgcggtcgcggttttagtaatagtagtaatttatgcatgcaccagcgcgtgcacacgggagaaaagccttttaaatgtgaggagtgtgggaaggcgtttaggcacacatcctccctttgcatgcaccaaagggtgcacactggcgagaaaccctataagtgctatgagtgcgggaaagccttctcacagtcatcttctctgtgtattcaccagcgggtgcacaccggagagaagccttacaggtgctgcggctgcgggaaggcgttctcccagtcttcttccctgtgtattcaccaacgcgtccacacgggagagaagccgtttaagtgtgacgagtgtggtaaggccttttcccagtcgacttcactgtgcatccatcaaagagtgcatactaaggaaaggaatcaccttaaaattagcgtgatctag

SEQ ID NO: 25694 - DNA, 786 bp, Artificial Sequence
  Description of Artificial Sequence: Synthetic coding sequence
atgatctacaagtgtccaatgtgtagagaatttttttccgagcgggctgacctgtttatgcaccagaagatccacacagctgaaaagccacataaatgcgataagtgtgacaaggggttcttccacatttctgagctgcatattcactggagggaccatacaggcgagaaggtctataaatgtgatgactgtggtaaagactttagtacaacaaccaaactgaataggcataagaagatccatacagtggaaaaaccctataagtgttacgaatgcggcaaggcattcaattggtcctctcacctccagatccacatgagagttcatacaggtgagaagccctacgtttgctcagagtgcggacggggattctcaaacagcagtaatctgtgtatgcatcaacgagtgcacactggcgaaaaaccattcaagtgtgaggagtgcgggaaagctttccgccacacgagctccttgtgcatgcatcagcgtgttcatactggggaaaaaccctacaaatgctatgagtgcggaaaggccttctcacagtcctcttcattgtgtatccaccaaagagtgcatacaggcgagaaaccctacaggtgctgcggctgcggaaaagcgttctcgcagagttcatctctctgcatccatcaacgcgtgcacacaggagagaaaccattcaagtgtgacgaatgcggaaaagctttcagtcagtctacttctctctgcattcatcagagggttcacactaaagagcgcaatcatctcaagatcagtgtgatttag

SEQ ID NO: 25695 - DNA, 2037 bp, Artificial Sequence
  Description of Artificial Sequence: Synthetic coding sequence
atggctctaccgcagggccaacttacattcaaggatgtggctatcgagttttctcaggaagagtggacctgtctcgaccccgcacagaagaccctgtatagggatgttatgctcgagaattatcggaatttagtctctctggatattagctgcaagtgtgtgaataccgacttgcctcccaaaggaaaaaataatatgggcgaggccttctacactgttaagttagaaaggctggagagctgtgacacagtgggcctcagcttccaagaagtgcagaagaatacatatgacttcgagtgccagtggaaagatgacgagggcaattacaaaacggttctgatgctccagaaggaaaacttacctggacgacgagctcagagagaccgacgtgctgccggaaaccgacacattgagaatcagttgggggtgagcttccagagtcacctgccagaactgcagcagtttcagcacgaaggcaagatctacgaatataaccaggtggaaaaaagccccaacaacagaggcaagcattataaatgtgacgaatgcggcaaggtgtttagccagaacagccggttgaccagtcacaagaggatacacaccggagaaaagccatatcagtgcaataagtgtggtaaggcatttactgttcgaagtaacctaactattcatcaagtgatacataccggagagaagccttataaatgcaatgaatgcggcaaggtatttagtcagccaagtaatttggccggtcaccaacggatccataccggagaaaagccttacaaatgcaacgaatgtggcaaagcattcagagcacacagcaaactgaccacgcaccaggtgatacataccggtgaaaagccatataagtgtaaagagtgtggcaagtgtttcacacagaatagccacctcgcgagtcaccgcagaatccatacgggagaaaaaccatacaaatgcaatgaatgtggaaaagccttctctgtgcgctcaagtctgacaacccatcagaccatccataccggcgagaaaccttataagtgcaacgaatgcgggaaggtgtttagacacaattcatatttggcaaagcataggaggatccataccggtgaaaaaccttataaatgcaatgagtgtggtaaagctttttcgatgcactccaacttaaccaagcatcagattatccacaccggtgagaaaccattcaaatgtaatgagtgtgtcaaagtgttcacgcaatacagtcacctcgccaatcaccgtagaatccatacaggcgaaaagccctataggtgcgacgagtgtggcaaggccttttccgtcagatcgagtttaaccacgcatcaggctatccacaccggcgaaaaaccatataaatgtaatgattgcgggaaagtgtttacacagaactctcacctcgcttcacacagagggatccacagcggtgagaaaccttataagtgtgatgaatgcggtaaggcattcagccagacctcccagttggctagacactggcgagtgcacacaggcgagaagccatataagtgtaacgagtgcggtaaggcattctcagtccatagctccctgacaatacaccagaccatacataccggacagaaaccctacaaatgcaatgattgcggtaaagtctttagacacaatagctatctcgctatccatcagagaattcacacaggtgagaagccatataaatgtaatgagtgtgggaaagccttcagcgtccacagcaacctcgccacgcaccaggtgatccacactggggaaaaaccctacaaatgcaacgagtgcggcaaagtctttacgcaaaactcacatctcgccaatcatcgtaggattcataccggcgagaaaccatataggtgtaacgagtgcggaaaggccttcagcgtaaggtctactttgaccactcatatggctgtacacacaggggataagccatacaaatgtaaccaatgcggaaaagtgttcacacaaaattccaatctggctaagcaccgacgaatccacagcggctag

SEQ ID NO: 25696 - DNA, 1860 bp, Artificial Sequence
  Description of Artificial Sequence: Synthetic coding sequence
atggaggttgaggcggcagaggcacgctcccctgcgccaggctataagcggtcaggaaggcgctataagtgtgtgtcatgcactaaaacttttccgaacgctcctagggccgctcgccacgctgccacccacggaccggctgactgtagcgaagaagtcgcggaagtaaagccaaaacctgaaaccgaggcgaaagctgaagaagccagtggcgaaaaagttagtggttcagccgctaagccaagaccatacgcctgccctctctgtccaaaagcatataagaccgcacctgagctccggagccatggccgatctcatacaggggagaagccctttccgtgtcctgaatgcggccgtcggttcatgcaaccagtgtgcctgagagtgcatttagcatcccatgcaggcgagctgccattccgatgcgcccattgtccaaaggcttatggagcactgtccaaactgaagatacatcaacgtgggcatacaggagaaagaccttatgcttgcgcagattgtggaaagagcttcgcagatcctagcgtgtttaggaaacatcgacgcactcatgccggactgcggccatattcctgcgaaagatgcggaaaggcatacgctgagctgaaagacctcaggaaccatgagcgctcccatacgggggagaggcccttcctctgctctgaatgtggcaagagcttcagtcgttcctctagcctcacttgccaccagcgtatccacgctgctcaaaagccttatagatgtcccgcttgtggcaaggggttcacccaactgagctcttaccagagtcacgaacgcactcattcaggagaaaaacctttcctgtgtccacgctgtggaaggatgttttcagatccttcctcattcagacgccatcaacgtgctcacgaaggtgtgaagccctaccactgtgagaagtgcggcaaggacttcagacagcccgcagacctggctatgcatcgcagagtgcacaccggggatcgtcctttcaagtgcctgcagtgcgataagacttttgtggcctcatgggatctgaagagacacgccttagtacactccggacagcgacccttccggtgcgaggaatgcggtcgcgctttcgctgagagggcttcattgaccaagcactcaagagtgcactctggggaaaggcccttccactgcaacgcatgcgggaagtcattcgtagtcagtagttccctccgcaagcacgagcgtactcatagaagtagcgaggccgctggggtgccacccgcacaagaattggtagtgggactcgctttaccagtgggggtagcgggagaatcgtccgcagcgccagcagctggcgctggcttgggggatcccccagccggtcttctggggcttcctcccgagtccggaggagtgatggccacccagtggcaagttgttggaatgaccgtggagcatgtcgaatgccaggacgctggagtgcgcgaagcccctggcccattagagggcgcaggcgaagcagggggtgaggaggctgacgagaaaccccctcaattcgtgtgcagagaatgcaaggaaactttttcaactatgaccctactcagacgccacgaacgctcccatcccgagttgcgccctttcccttgtactcagtgtggcaagagcttctcagatcgtgccggactccgtaagcattcccgtactcattcttcagtccggccttacacatgcccgcactgccctaaagcttttttaagcgcctcggacttgagaaaacatgagcgcactcaccctgttcccatgggcactcctacgccactggagccactcgtagctctcctaggcatgccggaggaaggcccagcttag

SEQ ID NO: 25697 - DNA, 1860 bp, Artificial Sequence
  Description of Artificial Sequence: Synthetic coding sequence
atggaggtcgaggctgctgaggcccgaagcccagcacccggatacaaaagatcagggagaagatataagtgtgtgtcctgtaccaagacgttcccgaatgcaccccgtgcggctcggcacgcggctacccacgggccagccgactgttcagaagaagtggccgaagtgaagccaaagcccgagacagaagctaaagcagaggaggcatccggcgagaaagtgtcaggctcagccgctaaacctcgcccttatgcctgccctctatgcccaaaggcttacaaaacagctcccgagttgcgctcccacggcagaagtcacaccggggagaaacccttcccctgccccgaatgtggtagaaggtttatgcaacccgtctgcctcagggtgcacctggcatcacatgccggagaactgccattcagatgtgcccactgtccaaaagcctacggggcactctctaaactgaaaatccaccaacgaggtcacactggcgagcgtccttatgcatgcgctgactgcggcaagtctttcgcagatccttctgtgtttaggaagcacaggcgaacccatgctggactccggccttacagttgtgaaagatgtggaaaagcctatgcagaactgaaggatctcaggaaccacgaacggtcccacaccggcgaacgaccttttctgtgtagtgagtgtgggaaatcattctccagaagttcttctctgacatgtcatcagcggatccacgctgcccagaagccctacaggtgccctgcatgcgggaaaggctttacccagcttagtagctaccagtctcacgagcggacgcatagtggagaaaaaccatttctgtgccccagatgtggcagaatgttttctgacccctcttcatttagacgacaccagagagctcatgaaggcgtgaagccctaccattgcgagaagtgtggtaaagattttagacaacctgctgatttggcgatgcatcgcagagtgcacacaggggataggccctttaagtgtctacagtgcgacaaaacttttgtcgccagctgggatctaaagcgacatgcattggtacattcaggtcaacggccttttcgatgcgaggagtgcgggagggctttcgccgaaagagcctcgctaaccaagcacagccgagtgcatagcggggagcggccttttcactgcaatgcttgcggaaaatcatttgtggtgtccagttccctgcggaagcacgaacgcactcaccggtcttcggaagcagctggtgtccctccagcccaggaactggtggttgggctcgcactgccagtgggggtggctggggagtcctctgccgctccagccgcaggcgctgggctgggcgatcccccagccggattattggggctgccgccagagagcggaggagtaatggccactcaatggcaggttgtcggtatgacagtcgagcatgttgagtgccaagacgctggtgtgcgggaagccccagggcctctagaaggcgctggcgaagcaggcggagaagaagctgatgaaaaaccaccgcagtttgtttgtcgagagtgtaaggaaaccttcagtacaatgaccttactgagacgccacgaacgatcccacccagaactgcggccattcccttgcacccaatgtggcaaaagtttttctgaccgcgctggcttgcgcaaacacagcaggacccactccagtgtgcgaccatacacctgtccacactgccctaaggctttcctgtctgcatcagacctccgcaaacacgagcgcactcatcctgtaccgatgggtacgccgactcctcttgaacccctagtcgctctcctgggtatgcccgaggaggggcctgcctag

SEQ ID NO: 25698 - DNA, 327 bp, Artificial Sequence
  Description of Artificial Sequence: Synthetic coding sequence
atggaagtcgaagccgctgaggcaagaagtccagcgcctggctataagagatctggccgacgatacaaatgcgtcagctgcaccaaaactttcccgaacgccccaagagcagctcgtcatgcagcaactcacggcccagccgactgcagcgaggaagtggccgaggtccctcatcgcagagcccctttgccattgctgagggtccgtgaagaacttttgcccctaatattggcgcatgtgcccccagcacacccacggggtaccgaagctctgccacttccgggacttcgccagggcctgcacgccgctcagtttctgcccgaatag

SEQ ID NO: 25699 - DNA, 279 bp, Artificial Sequence
  Description of Artificial Sequence: Synthetic coding sequence
atggaagtggaggccgcagaagcgaggtctcctgctccaggttacaaaaggtccggcagaagatacaaatgcgtgtcgtgtaccaaaacgtttccaaacgcacccagggcagccaggcatgctgccacgcatggcccagcagattgcagcgaagaagtggctgaggtgaaacctaagcccgaaaccgaggctaaggccgaggaggctagcggtgaaaaggttagcggttccgcagcaaagccacggccatacgcctgtcccctgtgccctaaagcatag

SEQ ID NO: 25700 - DNA, 231 bp, Artificial Sequence
  Description of Artificial Sequence: Synthetic coding sequence
atggaagtggaagccgctgaagccaggtcgccagcgcctgggtacaagcgctctggacgcaggtataagtgtgttagctgcaccaagaccttccccaatgcccctcgggctgcacggcacgccgcaacccatggcccagccgattgctctgaagaagttgctgaagtgaaaccaaagcccgaaaccgaggcgaaagcagaagaggcatccggagagaaggtcagcggatag

SEQ ID NO: 25701 - DNA, 312 bp, Artificial Sequence
  Description of Artificial Sequence: Synthetic coding sequence
atggaggtggaggctgctgaggcgcgatctcctgcccctgggtataagagaagcggcagaagatataaatgcgtgagctgcacgaagacattccctaacgcacctcgtgccgctcgtcacgccgctacacacggcccagccgactgttctgaagaagtcgcagaagtgaagccaaagcccgaaactgaggcaaaagcagaagaggccagtggtgaaaaggtgtctggatcagcagctaaacctcggccttatgcatgcccattgtgccctaaggcctacaagactgctccggaattgcgcagccatggctag

SEQ ID NO: 25702 - DNA, 1860 bp, Artificial Sequence
  Description of Artificial Sequence: Synthetic coding sequence
atggaggtcgaggccgcagaggcacgatctccagcacccggatacaaacggagtggcagacggtacaaatgcgtttcatgtaccaagacttttcccaatgcccctcgagctgcgaggcatgccgctacccatggtccagccgattgctctgaggaggttgccgaggtgaagcctaaacccgaaactgaggccaaagcggaggaagcatccggcgaaaaggtgagcgggagcgctgctaaaccgcgaccctacgcatgcccactgtgtccgaaagcgtataaaaccgctccagagttacggagccacgggagaagccacacaggagaaaaacccttcccttgccctgagtgtggacgacgcttcatgcagcccgtgtgtctgcgggtacacctggctagccatgccggagagctgcccttcaggtgcgcccactgcccaaaggcatatggggcactgagcaagctgaagatacatcagcgtggacacactggcgagaggccttacgcatgtgcagattgcggcaaaagttttgccgatccatccgtcttcagaaaacacagacgtacacatgccggtctccgaccctattcctgcgagaggtgtgggaaagcttacgctgaacttaaagatttacggaatcatgagaggtctcatacaggagaaagaccatttctgtgctctgagtgcggcaaatcctttagcagaagcagtagtttaacgtgtcaccagcggattcacgcagcccagaagccatatcgttgcccggcatgcgggaagggctttacccagttgtcttcttaccaaagccatgaacgtacgcattcgggagaaaagccatttctctgtcccagatgtggtagaatgtttagcgatccttcttccttccgtcggcaccaaagagcccacgagggcgtcaagccttatcactgcgaaaaatgcggcaaggactttcgacaaccagcggatcttgccatgcaccgacgggtgcatacaggcgatcggcctttcaaatgtctccagtgcgacaagacctttgttgcttcctgggatcttaagcgccatgcattagtgcactctggacagcgaccctttagatgtgaggaatgcggcagggcatttgcagagagggcctcccttaccaagcattcaagagtgcattctggcgaaagaccgtttcattgcaatgcctgcgggaagagcttcgttgtgtcttcctctctgaggaagcatgagcggacccacagatctagcgaggcagctggcgttccacccgctcaagagctcgtggtcggcttagcgctgcccgttggcgttgcaggtgaatcctctgcagcacctgcagctggcgctgggttgggggatcccccagctgggcttctggggctgccacctgaaagcggaggcgtgatggcaacgcagtggcaggtggtcggaatgacagtcgagcatgtcgaatgtcaggatgccggtgtgcgtgaggctcccggaccgctggagggcgcaggcgaggctggcggtgaggaggcagacgaaaagcctccacagtttgtgtgccgcgaatgtaaagagacatttagcaccatgactctgctaagaagacatgagcgatcacaccccgaactcaggccttttccatgcactcagtgcggcaagagtttttccgatagagctggactgcggaagcactccagaactcactcaagcgtccgcccttacacttgccctcactgtcctaaagccttcctgtctgcgtcggacctgcggaagcatgagagaactcaccctgtacccatgggcacccctacaccactggagcctctagtggctttactgggcatgcccgaggagggcccagcatag

SEQ ID NO: 25703 - DNA, 1860 bp, Artificial Sequence
  Description of Artificial Sequence: Synthetic coding sequence
atggaggtcgaggccgctgaagctcggtcccccgctccaggctacaagagatcaggccgtagatacaagtgcgtgtcatgtaccaaaacctttccaaacgcccctcgcgctgcaagacatgcagctactcacggacctgccgactgtagcgaagaggtcgccgaagtgaagccaaagcccgaaactgaggcgaaggccgaggaggccagtggggagaaagtctccggcagtgccgcaaagccacggccatatgcgtgtcccctctgccctaaggcttataagaccgccccagaacttcgctctcacggccgttcacataccggagaaaaaccatttccctgtccagaatgcggccgacgcttcatgcaaccagtttgcctgagagtccacctcgcgtcgcatgccggagaattgccatttcgatgcgctcattgtccaaaagcgtacggggctctgagcaagctgaaaatacaccagcgaggtcatacaggcgagcggccatatgcgtgcgccgactgcggaaaatctttcgccgatcctagcgtttttcgtaagcacaggcggacccacgccggactcagaccctactcctgcgagcggtgcgggaaggcatatgcagaactcaaagatctccggaaccacgaaagaagccacaccggagaacgccctttcctatgttctgaatgtggcaagagtttctcccgctcaagttccctgacctgtcaccagcggatccacgcggctcagaaaccttataggtgccctgcttgcgggaaaggcttcacacagctatcttcgtaccaatcccacgagaggacgcactctggggaaaaacctttcctttgtcctcgctgcggacgtatgttttccgatcccagctcttttcggcgacatcagagagcgcatgaaggcgtaaagccttatcattgtgagaagtgcgggaaggactttcggcagccagccgacttagcgatgcatagaagggtacacactggggacagaccctttaagtgcctccagtgcgacaagacatttgtcgcttcctgggatctcaagagacacgcgcttgtacacagtggacagcgacctttccgatgcgaggagtgtggcagggcttttgctgagcgcgcatcgcttacaaagcacagccgggtgcacagtggagaacgcccttttcactgcaatgcctgtggaaaatcattcgtcgtttctagctccctgcgtaaacatgaacgcacccaccggtcttccgaggcggctggcgtgccgccagcgcaggagctggtcgtaggcctcgctctccccgtgggtgtggccggagagagtagtgctgctcccgcagcaggtgccggactgggggaccctcccgcagggcttctaggcctgccgccagagtcgggaggagtcatggctactcaatggcaggttgttggcatgaccgttgaacacgttgaatgccaagatgccggagtgagagaggcgcctggcccactcgagggggctggcgaggccggtggcgaagaagctgacgagaaacccccacaatttgtctgccgtgagtgcaaggagaccttcagcaccatgacacttctgcggagacatgagaggagtcatcccgaactgagacccttcccctgcacacagtgcgggaagagcttctcagatagggctggtctgaggaaacactcccgtactcatagttccgtgaggccttatacctgcccacattgtcctaaggcctttctctcagctagtgatttgcgcaaacacgagcgaacccatcctgttcctatgggcaccccaaccccgttagaacccctggtggctctgctggggatgcccgaagaaggaccagcctag

SEQ ID NO: 25704 - DNA, 1929 bp, Artificial Sequence
  Description of Artificial Sequence: Synthetic coding sequence
atgtctgaacctgggatgcttggacgtaaggacgtgtgggttccaagagagaccccctttaccaaagccatggaagtagaggccgctgaggcaagaagccccgcaccgggttacaagcgcagtggaagaaggtacaaatgcgtgtcgtgcactaaaactttccctaatgcccctagggccgctcgccatgcagccacacacggacctgctgactgctcagaggaggtggctgaagtgaagccaaaaccagaaacagaggcaaaggccgaggaggccagcggggagaaagtcagcggatccgctgccaagcctcgtccttatgcatgcccactgtgcccaaaagcttacaaaacggcgccagagctgcgatcacatgggcgttctcacacaggggagaagccctttccgtgtccagaatgcggacgcagatttatgcagccggtgtgtctaagggttcatcttgctagccacgcgggagagctgccgttccgctgtgcccactgtcctaaagcatatggtgcactgagtaaacttaagatccaccagcggggacacactggagaaagaccctatgcatgcgccgactgcgggaaaagcttcgcggatccgagcgttttcagaaagcatcggcgaacccacgctggcctgcgcccttacagttgcgagcggtgcggaaaagcctacgctgaactgaaggatctacgtaaccatgaaaggagtcacacaggggagcgcccttttctctgcagtgagtgtggcaagtcattctctcgcagctcctccttgacctgccatcagaggatccacgcggcacagaagccttataggtgcccagcttgtggcaaaggcttcacgcaactaagctcttatcaatcccacgagaggacccattctggagaaaaaccatttctctgccctaggtgtggcaggatgttttccgatccttcctcattccggcgtcaccagagagctcacgaaggggtgaagccatatcattgcgagaagtgcggcaaagactttagacagcctgccgacctcgccatgcacagaagagtccacacgggggaccggccattcaagtgtctgcagtgtgacaagacgtttgtggcgtcctgggacttgaaaagacacgccctggtccatagcgggcagagaccgttcaggtgcgaggagtgcggcagagccttcgccgagcgggcatccctgacgaagcactctcgtgtgcattccggagaaaggccgttccactgcaatgcatgtgggaaatcttttgtggtttcttctagtctgcgaaagcacgaacgcacacatcggtccagcgaggccgctggagttcccccagctcaggagctcgttgttgggctcgccttacctgtcggcgtcgcaggcgaatctagtgctgcccctgccgcaggggcagggctgggagatccaccagccggactgctgggtctcccacctgagagtggtggggtcatggctacgcagtggcaagtcgtgggaatgacagtcgagcatgtcgagtgccaggacgccggagttagagaagcgccagggcctctagagggtgcgggagaagccggaggcgaggaagctgatgagaaacccccacaattcgtttgtcgggagtgtaaagaaacctttagcacaatgaccctcttaaggagacatgagcgctcccatcccgagctgcggccttttccctgtacacagtgtggcaagtctttcagcgacagagccggtttacggaaacacagccgtacccattcatctgtacgtccgtacacgtgcccccactgtcctaaagcctttctttcagctagtgaccttcggaaacatgagcgtacccatccagtgcctatgggaaccccaactccactggagcccctggtggcgctactagggatgccagaggaggggcctgcatag

SEQ ID NO: 25705 - DNA, 1395 bp, Artificial Sequence
  Description of Artificial Sequence: Synthetic coding sequence
atggtaagcggattaagattggccagcagaagcggggaggagggctggctcaagcctgccgtggctagactgggaccacctagacaccggctccgcaatctgcgcaccgaaagtccatggaggtcgagaggctctgtgcttttttgctcaggcccaggtcgagctggcagggccgctgaaccgcttcaccctgtatgtacctgcgggagacacttccggcgtccagagccttgccgagagccgcttgcgtcacccatccaggactctgtggcattcgaggacgtcgccgtcaacttcacccaggaagaatgggctctgctcgacagtagccaaaaaaatctttatcgggaagtgatgcaagagacgtgtagaaatttggcctccgtcgggtcgcagtggaaagatcaaaacattgaggaccatttcgagaagccagggaaggatatccggaaccacatcgtgcagcggttgtgcgagtcgaaagaggatgggcaatacggtgaagttgtctcacagatacccaacttggacctcaacgaaaacatctccactggcctaaagccttgcgaatgttccatttgtggaaaagttttcgtccggcactctctcttgaaccgtcatatactggctcatagtggctataagccctacggtgagaagcagtacaagtgtgaacaatgcggcaaattcttcgtgtccgtacctggagtcaggcgccacatgatcatgcattcaggtaaccccgcttacaagtgcacgatatgtgggaaagccttctacttcctgaactcagtggagcgccaccagcggactcacaccggcgaaaagccctacaaatgcaagcaatgcggcaaagctttcacagtgtctggcagttgccttatccacgaacgcactcatacaggcgagaaaccatacgaatgtaaggagtgtggcaaaacttttcgctttagctgttctttcaaaacccacgagcgtactcacaccggcgaacgcccttataaatgcaccaagtgcgataaagccttctcttgctccacctctttaaggtaccatggaagtatccacactggggagcggccatacgagtgtaagcagtgtggtaaggccttcagcagactttcaagtctatgtaaccatcgatcaacccacacaggtgaaaaaccgtatgaatgcaaacagtgcgatcaggctttttcccgcctaagttccctgcacctccacgagcgcattcacactggtgagaagccatatgaatgcaagaagtgcggtaaagcatataccaggtccagtcacctcacgagacacgaaaggtctcacgatattgaggcgggatgctcagacagtgcgtacaatccaagtactctcgggggtcagggggtgtggatagcttag

SEQ ID NO: 25706 - DNA, 474 bp, Artificial Sequence
  Description of Artificial Sequence: Synthetic coding sequence
atggtctccgggctgcggttggcctcccgatccggagaggaaggctggctgaagccagctgtcgctcggctgggccctccacgccataggcttaggaacctgcgcactgagtctccgtggcgttctagaggctctgtgctgttttgcagcggcccagggagagccggacgggcagccgaaccactacaccctgtgtgcacctgcggacgccatttccgtaggcccgagccgtgtcgcgagccactggccagccccattcaggactcagtggccttcgaggacgtcgccgtcaacttcacccaggaagaatgggcactcctcgactcctcccagaagaatttgtatagagaggtgatgcaggaaacatgccggaacctggcctctgtggagatcattagctacagggattgcgtgaaggtaaaaaagatggtgagcatggaaaaactgtcagcaaaattccagattctgatctag

SEQ ID NO: 25707 - DNA, 216 bp, Artificial Sequence
  Description of Artificial Sequence: Synthetic coding sequence
atggactccgtggcctttgaggacgtggctgtgaatttcacacaggaagaatgggcccttctagatagctctcagaaaaacctctatcgtgaggttatgcaggaaacctgtagaaacctagcgtctgtggaaattatctcatacagagattgtgtcaaagttaaaaagatggtctccatggaaaaactgtcagctaagtttcagatcctcatttag

SEQ ID NO: 25708 - DNA, 186 bp, Artificial Sequence
  Description of Artificial Sequence: Synthetic coding sequence
atggacagcgtggcctttgaggatgtcgcggtaaacttcactcaggaagaatgggcccttctggacagtagtcagaagaacctgtatagagaagtcatgcaggaaacttgtcgcaatcttgcatcagaagcaaacggtaagaccagaatcctcaaaatcacctcaaagaatctgggcaaaatttag

SEQ ID NO: 25709 - DNA, 1137 bp, Artificial Sequence
  Description of Artificial Sequence: Synthetic coding sequence
atggacagcgtcgcttttgaggatgtggcggtgaatttcacccaggaagagtgggcgcttctggactcctcccagaaaaatctctatcgagaagtcatgcaagagacatgtcgtaatttggcgagtgtgggatctcagtggaaagaccagaatatcgaggaccattttgaaaagccaggaaaggacattcggaatcacattgtgcagagactatgtgaaagtaaggaagacgggcaatacggagaggtggtgagccagatccccaatctggatctgaacgaaaacatctcaaccggccttaaaccttgtgaatgttccatttgcgggaaagttttcgttcgccatagccttctgaatcgccatatcttggcgcactctggctacaaaccatatggagagaaacagtataagtgtgagcagtgtgggaagttttttgtgagtgtgcccggagtgcgcagacacatgatcatgcatagtggtaatcctgcttataagtgtacaatctgcggcaaggccttttacttcctgaacagcgtcgagcgccatcagcgcacgcatacaggcgagaaaccatacaagtgtaaacagtgcggaaaagcgttcactgtttcaggaagctgtctgattcatgaacgtacccacactggtgagaaaccatacgagtgcaaagagtgcggcaagactttccgcttcagttgctccttcaagacccacgagcgcacccacaccggggagagaccgtataagtgtacaaaatgcgacaaggcgtttagctgttcaacaagtctccgataccatggatccattcatactggagaaaggccctatgagtgtaaacagtgtgggaaagcctttagtagattatctagtctttgcaaccacaggagtactcacactggtgagaagccttacgagtgtaaacagtgtgaccaggcgttttccaggctgtcctccctccaccttcacgagcggatccacacaggcgagaagccttatgagtgcaagaaatgcggcaaggcttatacaagaagcagccatctcacgaggcatgagaggtcccacgacattgaagcgggatgctcagactccgcctacaacccatctaccttaggcggacagggggtgtggattgcctag

SEQ ID NO: 25710 - DNA, 1137 bp, Artificial Sequence
  Description of Artificial Sequence: Synthetic coding sequence
atggacagcgtggcttttgaggatgtggccgtcaactttacacaggaggaatgggccctcctcgattctagccaaaagaacctgtaccgggaggtgatgcaggagacatgcaggaacctggctagtgtgggctcacagtggaaggatcagaacatcgaagaccacttcgaaaagcccggtaaagatatacgcaatcatattgtccaacggctttgcgaatccaaagaggatgggcagtacggagaggtggtttcacaaatacctaacctcgaccttaatgagaacatatcaaccggcctaaagccttgtgaatgcagcatatgtgggaaggtcttcgttaggcattcactcctcaaccgccatattttggctcacagcggatataagccttacggtgagaagcagtataaatgcgaacagtgtggaaaattcttcgtatccgttcccggtgtccgacgacacatgatcatgcacagtgggaatccagcttacaagtgcacgatctgcggtaaggcattctactttttgaactccgtggagcggcaccaacgcacccatactggcgagaaaccctataagtgtaaacagtgtggcaaggccttcaccgtatctggctcctgtttgattcacgagcgcacacacactggtgagaagccctacgaatgtaaggaatgcgggaagacgttccggttcagctgctccttcaaaacgcatgaacgcacccacactggggaacggccttacaaatgtacgaaatgtgataaggctttttcctgcagtacctcactgcggtaccacggaagtatccacaccggggaacggccatatgaatgtaagcagtgtggcaaagccttctcaaggctgtcgtcactctgtaaccatcgcagtacacacaccggtgagaaaccctatgagtgcaagcagtgcgatcaggccttcagtcggctttcctcgctccacctgcacgagagaattcatactggggagaaaccttacgaatgcaagaagtgtggcaaagcctacacccgcagcagccacctaacaaggcatgagagatcccacgatatcgaggccggatgtagtgactccgcctataacccgtccactcttgggggtcagggtgtgtggatcgcatag

SEQ ID NO: 25711 - DNA, 1170 bp, Artificial Sequence
  Description of Artificial Sequence: Synthetic coding sequence
atggatagtgtctcattcgaagatgtagcagtggccttcacgcaagaagaatgggctctactcgacccttcacagaaaaacttgtacagggatgtaatgcaagaaattttccgcaacctggcgtctgttggaaataagtccgaagaccaaaacatccaggacgacttcaaaaatccgggaagaaatctgagctcgcacgtggtggaaagactgtttgagataaaggaaggtagccagtacggcgagactttttctcaggactctaatctgaacctgaataaaaaagtaagtacaggtgtgaaaccatgtgaatgctctgtatgcgggaaagtctttatctgccactctgcactgcaccgtcacatcctcagccacattggcaacaagttgttcgagtgtgaagagtgccctgaaaagctttatcactgcaaacagtgtgggaaagcctttatcagcctgacgtcagtggacagacatatggtcacacacacctctaacggcccttacaagggaccggtctatgaaaagccatttgattttcctagcgtgttccagatgcctcaatctacatatacaggcgagaaaacttataaatgtaaacattgtgacaaagcatttaactattcctcatacctccgagaacacgagcggacacatacaggtgagaagccctacgcctgcaagaaatgtggaaagagcttcacctttagctcctccctacggcagcacgagaggtcccatacaggcgagaagccatacgagtgcaaggaatgtggcaaggcctttagcaggtccacatatctgggcatccatgaaagaactcacaccggggaaaaaccctacgagtgcattaagtgtggtaaggctttccgctgttctcgcgtactccgggtgcacgaacgaactcactctggcgagaagccctatgagtgtaaacaatgcggaaaagcatttaaatactcatccaatctatgtgagcatgagcggacacataccggcgtgaaaccctacggttgcaaggagtgcgggaagagttttacatcctcatctgcccttagatcacacgaaagaacacatacgggcgaaaagccctacgaatgtaaaaagtgtggcaaggcctttagttgctcttctagtctgaggaagcatgagcgagcctacatgtggtag

SEQ ID NO: 25712 - DNA, 357 bp, Artificial Sequence
  Description of Artificial Sequence: Synthetic coding sequence
atgggtctgctagcattcagggacgtcgctctggagttttctcccgaggagtgggagtgcttagaccctgctcagagatctctctatagggacgtcatgctggaaaattataggaatctcatcagcctaggactggccatgagcaagcccgaactcatcatctgcctcgaggccagaaaggagccatggaatgtcaacaccgaaaagactgcacgccactctgtggagacacgcttcaggcacgtcgggcaggccggactcaaactgctaacctcaggggatcccccagccctggcaagccagagcgccggaattaccggcaccgggcatcattgtcagccgatttgcgtcttttag

SEQ ID NO: 25713 - DNA, 1605 bp, Artificial Sequence
  Description of Artificial Sequence: Synthetic coding sequence
atgctctcacctgtgagccgcgatgccagcgatgctctgcagggaaggaagtgtctgagacccaggtcgcgcagattacccctgccggctgcagtacgagctcatggcccaatggctgagttgaccgattctgcccgaggctgcgtggtgtttgaggacgtttttgtctattttagccgcgaggagtgggagctgctcgacgatgcacagagactgctttaccatgatgtgatgctggaaaacttcgcgctcctggcctccttgggaattgcctttagtcgaagccgagccgtcatgaagttagaacgaggcgaggaaccttgggtgtacgaccaagtcgacatgacgtccgcaacggagcgggaggcccagcgtggtcttcggccaggatgctggcacggcgtggaagatgaggaggtatcatccgagcaatccattttcgtggctggcgttagtgaggtgagaactctcatggcagagctcgagtcccacccttgcgacatttgtggccctattctgaaggataccctgcatctggctaagtaccatggagggaaagcgaggcaaaaaccgtatctctgtggcgcatgtggcaagcaattttggtttagcactgactttgaccagcatcagaaccagccaaatgggggaaagttgttccccagaaaagaaggtagagactctgttaaaagttgtcgtgtccatgtgcccgagaagaccctgacgtgcgggaaaggtcggagggatttctcggctacttcagggctactgcagcaccaagcttccttgtcctctatgaagcctcacaagtctaccaagcttgtgtcgggatttcttatgggtcaaagatatcaccgatgtggcgagtgcggaaaagcatttaccaggaaggataccctcgctcggcaccaaaggatccacaccggcgaaaggccctacgaatgtaacgaatgcggaaaatttttttcacagtcctacgacttatttaagcatcagacagttcacactggagagagaccgtacgagtgcagcgaatgtggcaagttcttccgccagattagcggcctcatcgaacatcgtcgagtccataccggtgagagactttaccagtgcggcaaatgcggcaagttcttttccagtaagtccaacctgattcggcatcaggaagtgcacacaggcgctcgcccttatgtgtgctccgagtgtggcaaagaattcagccgtaaacacactcttgtactgcaccagcgaacccatacaggtgagcggccttatgagtgctccgaatgcgggaaagccttcagtcagtcgagtcatctgaacgtgcattggcgcatccactcctccgattacgagtgctcacggtgtggaaaagctttcagctgtatctcaaagctgattcaacaccagaaagttcatagcggtgagaaaccgtatgagtgctctaaatgtgggaaggcttttacacagcgccctaatctcatccggcactggaaggttcacaccggcgaaagaccgtatgtatgttcagagtgcggtagggaattcatacgcaagcagaccttagtactacaccagagggtgcatgcaggcgaaaaactgtag

SEQ ID NO: 25714 - DNA, 1311 bp, Artificial Sequence
  Description of Artificial Sequence: Synthetic coding sequence
atgaaactggaacgcggagaggaaccctgggtctacgaccaggttgatatgacctccgcaacggaaagagaagcgcagcgtgggctaagacccggatgttggcatggcgtagaggacgaggaggtgagctctgagcaaagcatctttgtcgcaggggtctcagaggtgagaactttgatggccgaattggagagtcatccctgtgacatttgcggaccaatcttaaaggacacacttcacctggcaaaataccatggtggaaaagcacgccagaaaccttacctctgtggagcttgcggaaagcaattctggttctcaaccgactttgaccaacatcagaaccagccaaacgggggtaaactgttccctaggaaagaaggtcgggacagcgtcaaaagttgtagggtccatgtccctgaaaaaaccctgacttgcgggaaaggcagacgcgacttctctgcaaccagcggattactgcaacaccaggcctcactctcttctatgaaaccccataaatcaaccaagttggtgtccgggttcctcatgggacagcgctatcatcgttgcggggagtgcggtaaagccttcacaaggaaggacaccctcgcccgacaccagaggatccacactggtgagaggccatacgagtgcaacgagtgtggtaagttcttctcccagtcctatgatctattcaaacaccagaccgtgcacactggtgaacggccatacgaatgttccgaatgcggtaagttctttcggcaaatcagtggactgatcgagcaccgccgagttcacaccggggagagactctaccaatgcggtaaatgcggcaaatttttctcctctaaatccaacctaattcgacatcaggaagtccacacaggagccagaccctacgtctgctccgagtgcggcaaagaattcagccggaagcacacgttagtcctgcaccagcggacccacaccggggagcgcccttacgagtgttctgagtgtggcaaggcttttagtcagtcatcacatctcaatgttcactggagaatccacagctctgattatgagtgcagccgctgtggcaaggctttttcttgcatctcgaaactgatccaacaccagaaggttcattccggcgagaagccctatgagtgtagtaagtgtggcaaggcctttacacagcgaccaaacctcatacggcactggaaggtacatacaggcgagcgcccttatgtttgctccgaatgcggccgagagttcattcggaaacaaaccctcgttctgcatcaaagggtccatgctggggaaaagctgtag

SEQ ID NO: 25715 - DNA, 1359 bp, Artificial Sequence
  Description of Artificial Sequence: Synthetic coding sequence
atgtttgcaacctctggggctgtcgccgcaggcaaaccgtattcgtgcagcgaatgcggcaaatctttctgctactctagcgtgctgctgcggcacgaacgggcacacggaggtgatgggaggttccgatgcctggaatgcggcgaaaggtgcgccagggctgcagacctgcgggctcaccggcgtacacatgccggtcagacgctttatatctgttctgaatgcggtcagtctttccggcattccggaagactggatctgcacctcggcgcacacaggcaacgctgccggacatgtccttgtagaacgtgcggtagacgcttccctcacttgcccgcactactcttacacaggagacgacaacaccttcccgagagacccagacgctgccctctttgcgcaaggactttcagacagtctgctctcctgttccaccaggccagggctcaccctttaggcactaccagtgatccggcagcccctccacaccgctgtgcccagtgcccgcgagcctttcgctctggagctgggttgcgctcacatgcaaggatccacgtttcgagatctcccactaggcctagagtgagcgacgcccaccaatgcggcgtatgtggcaagtgcttcggaaaatccagcaccctaaccagacatcttcagacacactcgggcgagaagccgtttaagtgccccgagtgcggcaaaggcttcttggagagtgccaccctggtgcggcatcagcggacccacaccggcgaaaagccctacgcctgtggtgattgcgggagatgcttcagcgaatcgtcaaccttactcaggcaccggagatcacatcagggcgaaaggccccacgcatgcgccacctgtggtaaaggttttggccagcgctcagatctagttgtgcatcagaggattcacacaggagagaagcctttcgcttgtccagagtgtggcaggcgctttagcgacagatccgatctgacaaaacaccggaggacgcacactggcgagaagccatatcgttgtgagctgtgtggcaagcgcttcacttgcgtgtcgaatctgaatgtgcaccgacggaaccatgccggacataagccccacaagtgtccagagtgctccaaggccttcagcgtcgctagcaaacttgccctgcaccgtaaaactcaccttggcgaaaggcctgccgagtgtgccgagtgcggcaagtgtttttctcattcccgctctcttagtcagcaccagcgagcacatacccgcgcaaggacagccgctgcagtggccatccagtccgctgtgggcaccgccctggttttcgaggggccagccgagcaagagaagccaggtttctcagtttcttag

SEQ ID NO: 25716 - DNA, 672 bp, Artificial Sequence
  Description of Artificial Sequence: Synthetic coding sequence
atgttcgctacctctggcgcagttgcggcaggaaaaccctacagctgttctgaatgcggcaagtctttctgctactctagtgtgctgctgagacacgagagagcgcacggaggggatggacgattccgctgtcttgagtgcggcgagcgttgtgcccgtgccgctgaccttcgcgcacataggcgcactcacgccggtcaaactttgtacatttgttcagagtgtggacagtctttccgacattctggcaggctagatttgcaccttggtgcccatcggcagcggtgccggacatgcccatgcaggacatgcgggaggcggttcccccacctgccagctttactgctgcaccgcaggaggcagcacctgcctgaaaggcctctcctgccctgctgccctcgcataacgcgaatcctgtcgtccggtgtcggcgctggaagtcaaggcaccctgagactgccgtgtgtgcaggagccacggtgctggtgcgtgcctctgatgctgctgtgctccctggtgttcttaatatttcttccgctgttttgtttgttactgagctacctgatccctgcgcatatattcagttttcccgattatttctgttgccccgcatctagcggaaatgggcacaggtttggttgtcgtcatgtgacatcaccagtggcctcatag

SEQ ID NO: 25717 - DNA, 114 bp, Artificial Sequence
  Description of Artificial Sequence: Synthetic coding sequence
atgttcgcaacaagcggggcagttgcagccggaaagccgtactcttgcagcgaatgtggaaagagcttttgctattcttcagtcctgctccgacacgagcgtgcacacggctag

SEQ ID NO: 25718 - DNA, 210 bp, Artificial Sequence
  Description of Artificial Sequence: Synthetic coding sequence
atgtttgcgacctccggcgctgtcgctgcagggaaaccctacagttgctccgagtgtgggaagagtttttgttatagcagcgtgctgcttcgacacgaacgagcacatggtggcgacggaagattccgttgcctggaatgtggagaaaggtgcgccagagcagccgacctgagggcacatagacgaacacatgccggacagacgctgtag

SEQ ID NO: 25719 - DNA, 15 bp, Artificial Sequence
  Description of Artificial Sequence: Synthetic coding sequence
atgttcgccacgtag

SEQ ID NO: 25720 - DNA, 1767 bp, Artificial Sequence
  Description of Artificial Sequence: Synthetic coding sequence
atgctcgaaaattaccgtaaccttgtttttttaggaatagctgccttcaagccggatctgatcatctttcttgaacaggggaaggagccgtggaacatgaagcgacatgagatggtggaggaacctcctgtgatctgtagtcattttagccaagagttttggccagagcaaggaatcgaggacagcttccagaaaatgatccttcgcaggtatgacaaatgtggccacgagaatctgcacctcaagatctcctgtacaaacgttgacgagtgcaatgtacacaaggaggggtacaacaaactcaatcagagcctgacaaccacccagtcaaaggtcttccagtgtgggaaatacgctaacgtgtttcacaaatgctcaaactcaaaccgccataagatccggcacacaggggagaaagggctgaaatgtaaagagtatgtgagatctttctgcatgctttctcacctcagtcagcacgaacgaatctacacccgggagaatagttataaatgtgaggaaaatgggaaagcatttaactggtcatcaactcttacttactacaagtccatccacacaggagaaaagccgtataagtgcgaggaatgtggcaaggctttcagcaaattctccatcttgacaaagcataaggtcatccacacaggggaaaaaccctacaaatgcgaagagtgcggcaaagcctttaaccggtcctctatcttaacaaaacataagatcatacacaccggcgaaaagccatataagtgcgaggagtgcggtaaggggttttcttcagtgtccaccttaaacacccacaaggcaatccacgccgaggagaagccctacaagtgtgaagagtgtgggaaagccagtaatagctcttccaagctcatggagcataagcggattcacactggggagaaaccctacaaatgcgaagagtgtggtaaggcattcagctggagttccagcctaaccgagcataagagaattcacgctggcgagaaaccttacaaatgcgaggagtgtggcaaggccttcaacagaagctccatcctaaccaaacacaagatcatccacacaggcgaaaagccctataaatgtgagggatgcggcaaagcattctccaaggtcagcacactgaatacccataaagccattcatgccgaggagaaaccctataagtgcgaggagtgtggaaaagcatctaatagttcgtccaagcttatggagcacaagcggatccatacaggagaaaagccatacaagtgcgaagaatgcggtaaagcttttagctggagctcaagcctgaccgagcataagagaatccatgctggagaaaagccttacaaatgcgaggagtgtgggaaagccttcacgtggtcaagctcttttacgaaacacaaacgtatacacgctgcagaaaagccttacaaatgcgaagaatgcggcaagggcttcagcacgttttctatactgacaaagcataaaattattcacacaggtgaaaagcgctacaaatgtgaggaatgtggtaaagcattctcctggagttccatcctcaccgagcataaaattattcatacgggcgaaaaaccatacaagtgtgaggagtgtggtaaagcgttctcaaggtcctctagcttaactagacacaagaggattcacactggggagaaaccctataaatgcgaagaatgtgggaaggcgtttaagagtagctcaaccgtgtcctatcacaaaaagatccacaccggtgaaaacccatag

SEQ ID NO: 25721 - DNA, 1755 bp, Artificial Sequence
  Description of Artificial Sequence: Synthetic coding sequence
atggcactgagccagggtctgttcacatttaaggacgttgccatcgagttctctcaggaagagtgggagtgcttagatcccgcacagcgcgctctgtatcgggacgtcatgctagagaactatcgcaacctgctcagccttgacgaagacaatataccgcctgaagacgacatttccgtgggcttcacctccaaaggactcagccccaaagaaaataacaaagaagaactgtatcacctggtgatactcgaacgaaaggaaagtcacggtatcaataacttcgaccttaaggaggtatgggagaacatgcccaagtttgattccctttgggactacgacgtgaaaaattataaaggcatgcctttgacctgcaacaaaaatctaacacatcgaaaggatcagcagcataacaagtccagcatccacttttcgctaaagcagtcagtttcaattcgtgattctgcccaccaatatttcatccatgacaagcctttcattagaaatcttctgaaattgaaaaacaatatcagatacgctggaaataaatacgtgaagtgttttgaaaataagattggattgagcttgcaggcccaacttgcagagctgcaaagattccagactggtgaaaaaatgtatgagtgtaacccagtcgaaaagtccatcaattccagcagcgttagtccgctgccaccatgtgtgaagaacatatgcaacaaatatagaaagatcctgaagtatcctctgttgcatacccagtatggcagaactcacatccgagagaaatcgtataaatgtaatgattgcggaaaggcgttctccaagtcttctaatcttactaatcaccagcgtatccatagtggccagagaccctacaaatgtaacgaatgcggcaaagcctttaaccagtgttccaacctgacacggcatcagagagtgcatacaggcgagaagccctatcagtgtaatatctgtgggaaggtttgctcccagaacagcaaccttgctagccatcaaagaatgcatacgggcgagaagccgtacaagtgcaacgagtgtggcaaagcctttattcaacgttcgcacctctggggccacgagcgcattcacacgggggagaagccctacaagtgtaacgaatgtgacaaagcattcgctgaaagatcctccttgacccagcacaagagaattcatacaggggaaaagccatacatttgtaacgaatgcggtaaagcattcaaacagtgcagtcacctaaccagacaccaaaacatacatcccggtgaaaagcctcacaagtgtaatgtgtgcggacgagcgtttattcagagctcaagtcttgtcgaacaccagagaatccacaccggcgagaagccctacaagtgtaataaatgtgacaaggccttcatcaagcgcagtcacttgtggggtcatcaacgtactcatactggtgagaagccctataagtgcactgaatgcggtaaagcctttacagagaggagcaacttgactcagcataagaaaatccataccggtgagaaaccctataaatgtaccgagtgcggcaaagcttttacacaatttgctaacctgacgcgccatcaaaagattcatatcgagaagaagcactgtaagcacaacatacacggaaacgccttgtttcagtcaagcaacttgggcgatcaccagaaatcttacaacagagagaagcatattaaatacaatgagacaaaaatcaagtactcgtcctgcacatag

SEQ ID NO: 25722 - DNA, 540 bp, Artificial Sequence
  Description of Artificial Sequence: Synthetic coding sequence
atggccttatcccagggactctttacctttaaagatgttgccatcgagttttcccaagaggaatgggagtgcctcgacccagcccagcgagctctttacagggacgtgatgttggagaactaccgcaatctgctatcgcttgatgaagacaacattccacctgaggacgatatctctgtcggcttcaccagtaaaggcttgagtccaaaagagaacaataaagaggaactgtaccacctggtaattctagagagaaaggaatcccacggaatcaacaatttcgacctaaaagaggtgtgggagaacatgccaaagttcgattcactgtgggattatgacgttaagaattacaagggtatgcccctgacgtgtaacaaaaacttaacccataggaaagaccagcagcacaataagtcatcgatccacttctcgctcaagaaaaaaaagaaaaaaaagaagaagcagaataaaacgaaaccgaaggccaccaaggagaaacggcgaaagaacaaaggcaagaataaaacaaatacaaaatag

SEQ ID NO: 25723 - DNA, 1578 bp, Artificial Sequence
  Description of Artificial Sequence: Synthetic coding sequence
atgggcaccattagcctttgtattggagtgtgcgcgttcgaaggggcaaacacttcaacctccttctataaactcgtctacaccgcaattctcagttattctattcaggatttactgcctgaacaggatatgaaggatctctgtcaaaaagtcaccctgacgagacataggagttggggtcttgacaacttgcatttagtgaaggattggagaaccgtcaatgaaggaaaaggccagaaggaatattgtaatcgcctaacacagtgttcctctaccaaatcaaaaatctttcagtgtattgagtgcggcagaaacttctcatggaggtcaattctgaccgaacataaaagaattcacaccggcgaaaagccctacaaatgtgaggaatgcggcaaggtgtttaatcgctgctccaatctgacaaagcacaagcgaatccataccggagaaaagccgtataaatgcgacgaatgcgggaaagtgttcaactggtggagccaattgaccaaccacaagaagatacacacaggtgagaagccttacaaatgcgatgagtgtgataaagtattcaactggtggtctcagctgacaagccataagaaaatccacagtggagaaaaaccatacccttgtgaggaatgcggtaaggcatttacgcagttttctaatttgacacagcacaagcgcatccacaccggagagaagccttataagtgcaaagaatgttgtaaagcctttaacaagttctctaatctcacacagcataagcggatccatactggtgagaaaccctataagtgcgaggagtgtgggaacgtgtttaacgaatgcagccacctgacacggcacagacgcatccacacgggtgaaaaaccctataaatgcgaagagtgcggcaaggcttttacccaatttgccagccttaccagacacaaacggatccacaccggggaaaagccctaccagtgtgaggagtgcgggaaaacctttaatagatgttcccacctctctagtcataagcggattcataccggggaaaaaccttataaatgtgaagagtgcgggagaaccttcacacaattcagcaatctgacccaacataagcggatacacaccggagagaaaccatacaagtgtaaggagtgcggcaaggcttttaacaaattttcgtctctcactcagcatagacggatccatacaggggtcaagccctataagtgtgaggaatgcggcaaggtctttaagcagtgcagtcatctgactagccacaagagaattcatacaggcgagaagccttacaagtgcaaagaatgcggaaaggcattctatcagtccagcatcctctcaaagcacaagcgaatacatactgaggaaaaaccatacaagtgtgaagaatgcggaaaggcattcaaccaattttcaagcctcacgcggcacaaaaggattcacactggcgagaaaaggtataaatgcaaagaatgcgggaaaggcttctaccagagctctattcactctaaatataagcggatctacaccggagaggagccagataaatgcaagaagtgtgggagcctgtag

SEQ ID NO: 25724 - DNA, 1743 bp, Artificial Sequence
  Description of Artificial Sequence: Synthetic coding sequence
atgccaggccaccccgaatctcgcaaaacccgacgcattctcacaatgctaccacggttagtccttaattcattcccacaggtgatcttattgccaaatccacctaaagttctgcggctccagggactcctcgccttttcagatgtggtgatcgagttctctcccgaagagtgggcatgtttagaccctgcccaacgcaacttgtaccgcgatgtgatgtttgaaaactatagaaatttggtgagccttgcaatcctgtcctactctatccaggatttgctgcccgaacaagatatgaaagacctgtgtcaaaaggtgaccctgacaaggcacagatcatggggattagacaacctccacttggttaaggattggcggaccgtcaatgagggcaagggacagaaggaatactgcaataggctcacgcagtgttcctccaccaaaagcaaaatattccagtgtattgagtgcggcagaaacttttcttggagatctatattgactgagcacaaacgtatccacaccggggagaagccgtataaatgtgaggagtgcggcaaagtgttcaacaggtgcagcaacttaacaaagcacaaaagaatccacaccggggagaagccttacaaatgtgatgagtgcggtaaggtctttaattggtggtctcagctgaccaaccacaaaaagatacacacaggagaaaagccatacaagtgtgacgagtgtgacaaggtcttcaattggtggtcccaactcacatctcacaagaaaattcactccggcgaaaagccctatccgtgtgaggaatgcgggaaagccttcacccagttttctaatctgacccaacacaaacggatccataccggcgagaaaccttataaatgcaaggaatgttgcaaagcctttaacaaattcagcaatctgacgcagcacaaacggatccacaccggtgagaagccctacaaatgcgaggaatgtggcaatgtgtttaacgaatgctcacacctgaccaggcacagacggatccacaccggcgaaaagccctacaaatgcgaagaatgcggtaaggcatttacgcagttcgcctctctcacacgccacaagaggatacacacaggtgaaaaaccatatcagtgcgaggagtgtgggaagactttcaacagatgcagccatctgtcttctcataaacgtatccataccggcgagaagccatataagtgcgaagagtgcggcaggacctttactcagttttccaatctgactcagcacaaacgaatccacactggagaaaagccctacaagtgcaaggagtgtggaaaggcattcaataaattttcctccttgacccagcacaggcggattcatacgggagtgaaaccgtacaaatgcgaggagtgtggcaaagtattcaagcagtgttcccacctcaccagccacaaacgcatccatacaggcgaaaaaccttataagtgcaaagaatgcggaaaagccttttatcagtcatctatcctttccaaacacaaaaggattcacaccgaagagaaaccatacaaatgcgaagagtgtggaaaggccttcaaccagttctctagcctcacacggcataagagaatccacacaggggagaagagatacaagtgcaaggagtgcggaaagggtttctatcagagctcaatccatagtaaatacaagcgtatctacaccggtgaggagccagataaatgcaaaaagtgcggctccctctag

SEQ ID NO: 25725 - DNA, 684 bp, Artificial Sequence
  Description of Artificial Sequence: Synthetic coding sequence
atgcccggacaccctgagtcccggaagacacggaggattttaaccatgctccccaggttggtgctgaacagctttccgcaagtcatcctgctgcccaatcccccaaaagtgcttaggctgcagggactcctggcctttagcgatgtggtaatagagttctcgccagaggagtgggcatgtctggacccagcacagaggaacttatacagagacgtcatgttcgagaactaccgcaacctggtgagtctcgccattctgtcttattccatccaagacctcctacccgaacaggacatgaaggatctgtgtcagaaggtgacattgacccgccaccgcagctgggggcttgataacttacacttggtgaaggattggagaacagtcaacgagggcaagggccagaaagaatactgtaaccgcctcacacagtgctctagcactaagagtaagatcttccaatgcatcgagtgtggacgaaatttctcctggcggagcattttgacagaacataagaggatccatacaggcgagaaaccatataaatgcgaggagtgtggaaaggttttcaatcgatgctctaacctgacgaaacacaagaggatacatactggagaaaaaccctacaagtgtgatgagtgtggcaaggtgttcaattggtggtcccaattgaccaaccacaagtag

SEQ ID NO: 25726 - DNA, 1236 bp, Artificial Sequence
  Description of Artificial Sequence: Synthetic coding sequence
atggcgaagcgcccaggaagccctgggtccagagagatgggtctcctgacgttcagggatgtggtaatcgagttctccctcgaggaatggcagtgccttgaccacgctcaacagaatttatatagggatgtaatgcttgaaaattaccggaatttagtgagcctaggcattgcggtgtctaaacccgatttgattacatgtctcgagcaaaacaaagaaccttggaatattaaacggaacgagatggtgacgaagcaccctgtgatgtgctctcatttcacacaggatttaccacccgagctaggtatcaaggatagtcttcagaaagtaatccccaggcgctacgggaaatccggccacgacaatcttcaagttaagacatgcaaatctatgggcgagtgcgaggtgcagaaggggggatgtaacgaggttaatcagtgtctcagcactacccagaacaagatcttccagacacataagtgtgtcaaagttttcgggaagttttcgaattcaaacagacacaaaacgaggcataccggcaaaaagcatttcaaatgcaagaaatacggtaaaagcttttgcatggtgagccagcttcaccagcatcaaataattcatacacgcgagaattcttaccagtgcgaggagtgtggaaagccttttaactgcagcagcacactttctaagcacaaaagaattcacacaggggagaagccgtataggtgcgaggaatgcggtaaggcttttacttggtcttctacactgaccaagcatagacgcatccataccggggaaaagccatacacatgcgaggagtgcggacaagccttcagcaggtcaagcacactggcaaaccacaagaggatccacaccggagaaaagccatatacttgcgaggaatgtggcaaggccttcagccttagcagcagcctcacgtatcacaagcgcatccacacaggcgaaaaaccctatacatgcgaagagtgtggtaaggcatttaactgctcctccaccctgaagaagcacaagataatccacactggggaaaagccctataagtgtaaagaatgcggcaaagcattcgcgtttagttctacactgaatacccacaagcgcatacacacaggagaagagccatataagtgtgaggagtgtgacaaggcttttaaatggtccagctctttggccaaccacaagtctatgcacaccggagaaaagccctataaatgcgagtag

SEQ ID NO: 25727 - DNA, 1236 bp, Artificial Sequence
  Description of Artificial Sequence: Synthetic coding sequence
atggccaagcgtcccggaagtcccggtagccgggagatgggattgttgacctttcgagacgtcgtcattgagttcagcttggaggagtggcagtgtttggaccacgctcagcagaacttgtatcgggatgttatgcttgagaattaccgcaatcttgtctccctgggaattgcagtcagcaagcccgatctaatcacctgtctcgaacaaaataaggaaccgtggaatataaaacggaatgaaatggtgacgaagcacccagtcatgtgcagccacttcactcaggacctgcctcccgaactcggaattaaggactccctgcagaaggtaattcctcggagatacggcaaatcaggtcacgataatctgcaggtcaagacgtgcaagtctatgggagaatgcgaggtacagaagggcggatgcaatgaggtgaaccagtgtctgagcaccacacaaaacaagatttttcagacacacaagtgtgtaaaagtctttggaaaattctccaattctaaccgccacaaaactaggcataccggcaaaaaacattttaagtgtaaaaagtacgggaagtctttctgcatggtgagccaactccaccagcaccagatcattcatacaagggagaacagttaccagtgtgaggagtgcggcaagccgtttaactgctctagcaccctgtcaaaacataagcggatccacactggcgaaaaaccctatcgctgtgaagagtgtgggaaggccttcacttggagttctaccctgactaagcaccgacggattcatactggcgagaagccctatacctgtgaagaatgtggacaagctttttctaggtcctctacccttgctaaccataaacgaatccacactggtgaaaaaccctacacctgtgaggagtgcggaaaagctttctccttgtcatcaagcctgacctaccacaagcgaatccatacaggggagaagccctatacttgtgaggagtgtggcaaagcttttaactgctcctcgaccctcaagaagcacaagatcattcacacgggagaaaaaccatataaatgcaaagaatgcggcaaagcatttgcattcagctctacattaaatacgcacaaacgaatccacacgggcgaagagccttacaagtgcgaggaatgtgacaaagctttcaagtggagctctagtttggctaaccataagtctatgcacaccggggagaagccttacaagtgcgagtag

SEQ ID NO: 25728 - DNA, 1593 bp, Artificial Sequence
  Description of Artificial Sequence: Synthetic coding sequence
atgccagggccaccagggagtttagaaatgggaccactgacattccgcgacgtggcaatcgaattttcgctcgaggagtggcagtgcctggacactgctcaacgaaacctctatagaaaagtaatgtttgagaactaccgaaatcttgtgttcctcggcatcgcagtgtcaaaacctcacctgattacttgcctggaacaagggaaggagccatggaaccgcaagcggcaagagatggtggccaagccaccagtgatctattctcactttactgaggatctgtggcccgaacactccatcaaagatagcttccagaaagtgattttgcgcggttacgggaagtgcgggcacgagaacctacagctacgcatcagttgtaagtccgtagacgagtctaaggtgttcaaagaaggctacaacgagttaaatcagtgtttgcgcacgacccagtctaagatcttccaatgcgataaatatgtgaaggtatttcacaagtttagtaactccaatagccataaaaagaggaataccggaaagaaggtttttaagtgtaaagaatgcggcaaatccttttgcatgctgtcacatctgactcaacatattcgcattcacacccgtgagaatagttataaatgcgaggagtgtgggaaagtgctcaattggttcagcgagctgataaagcataaaggcattcacatgggggaaaagccttataagtgcgaggagtgtggcaaagcatttaaccagagcagcaccctcatcaagcacaaaaagatccatattgaagaaaaaccattcaagtgtgaagagtgtggaaaggcattcagccttttttcgatattgagtaaacacaagattattcacactggcgataaaccctacaagtgtgatgagtgtcacaaagctttcaattggttcgctacactgaccaaccataaacgaattcatactggggaaaagcccttcaaatgcgaagagtgtggtaaagatttcaaccagttcagcaacctgacaaagcacaaaaaaatccacaccggggaaaaaccctacaaatgcgaagagtgtgggaaggccttcaatcaattcgctaatttgacaaggcacaagaaaatccatactggagagaagagctacaagtgtgaagagtgtggaaaggccttcatccaatctagcaacctcacagagcatatgcggattcatacaggcgagaaaccctacaaatgcgaagaatgcggaaaagccttcaacggctgttccagtctcactagacacaagagaattcacactcgagagaatacatacaagtgtgaggagtgtggcaagggctttaccttattctctaccctcacgaaccataaagttatccataccggagagaagtcttataagtgtgacgagtgcggtaacgtcttcaattggccagccacacttgccaaccacaagcggatccatgcgcgagaaaagccatataagtgcgaagagtgcggaaaggctttcaataggtcaagtcatctgacacgccacaagaaaatacacactggggagaaactgtacaagcctgagaagtgtgacaataacttcgacaacacatag

SEQ ID NO: 25729 - DNA, 372 bp, Artificial Sequence
  Description of Artificial Sequence: Synthetic coding sequence
atgccaggacctcccggatcactggaaatgggcccactcactttccgtgatgtggcaatagaattttcgctcgaagaatggcagtgtctagacaccgcccagcgtaatctgtatagaaaagtgatgtttgagaactatagaaaccttgtgtttctggggatcgccgtatcaaagcctcacctgattacttgtttggagcaggggaaggagccctggaaccggaagcgccaggaaatggttgccaagcctcctgaaagctattgtgtggcacaggccgatctcgagctcctcgttagctcttacttaacagctctcgccagcttaaagatgtgggactatcgtaacaatcctctttgtcaggccactatgtag

SEQ ID NO: 25730 - DNA, 1731 bp, Artificial Sequence
  Description of Artificial Sequence: Synthetic coding sequence
atggtcgcggagccaccagtgatctgctctcatttcgcccaggatttcagtcctgagcagaacatcaaggatagtttccaaaaggtgacaccaaggcggtatgggaagtgtgagcacgagaatttgcaactaagcaaatcagtggacgaatgcaaggttcagaagggaggctataacggactgaatcaatgcctccccactacacagtcaaaaatctttcagtgcgacaagtatatgaagatctttcacaaattctcaaatctgaatgggcacaaggtccgccataccaggaaaaaacccttcaaatacaaagaattcggaaaaagcttttgtatcttcagcaatcttacacagcataagataatctgcaccagggtgaatttttataagtgtgaagactgcggcaaagctttcaacggaagctcgatattcactaaacacaaacgcatccacatcggcgagaaatcttacatatgtgaggagtgcggcaaggcttgtaatcagtttactaatctgactactcataaaattatttataccagagataagttgtacaaacgcgaggagtgcagtaaggcgtttaacctgagttctcacattaccactcatacgatcattcataccggtgaaaacccatataagcgcgaggaatgcgacaaagccttcaaccagtctctgaccctgacaacacataagatcatccacacccgggaaaagctgaacgaatacaaggagtgcggcaaggctttcaaccaaagctcacatctgactagacataagattatccacactggcgagaaaccgtacaaatgtgaggagtgcggcaaggcctttaaccaaagctcccacttgacccgccataaaataatccacacaggcgagaagccttaccggtgtgaggagtgtggaaaggcttttaggcaaagctctcatctgaccacgcacaagatcattcatactggagagaaaccatataagtgcgaagagtgtggaaaggcattcaataaaagttcgcatctaactcgccacaagagcatccacacaggggaaaagccctatcagtgcgagaagtgtggcaaggcctccaaccagtcaagtaatctcactgaacataagaacattcataccgaggagaaaccctacaagtgtgaggagtgtgggaaagcctttaatcaattctccaacctgactacccacaaacgcattcatacgggcgagaaaccatacaagtgcgaagaatgcggaaaggctttcaatcagagctcgatcttgacaacccataaacgaattcacacaggagagaaatcctataagtgtgaggagtgtggaaaagctttctacaggagctccaagctcaccgaacacaaaaagattcacactggggagaagccatacacctgcgaggagtgcggaaaggcgttcaatcactcctcccacctggccactcataaagtgatacacactggggagaaaccctaccagtgtgaagagtgcgggaaagcttttaaccagtcctcccatctgacccgacacaaaaggattcacacaggcgagaagccctaccagtgcgaaaagtgcggaaaggcctttaatcaatcctcaaatctcaccggccataaaaagatacatacaggggagaaactgtataagcccaagaggtgtaatagcgattttgaaaatacttccaaattctctaagcacaagaggaattatgctggagagaaaagctag

SEQ ID NO: 25731 - DNA, 1938 bp, Artificial Sequence
  Description of Artificial Sequence: Synthetic coding sequence
atggagcccttgaaatttagggacgtggcgatcgaattcagcctggaggagtggcagtgtcttgacactatccaacagaatctctacagaaatgtgatgctggaaaactaccgcaacctggtgtttcttggaatagtagtgtccaagccggaccttatcacctgcttagaacaggagaaggagccttggaccagaaagagacacaggatggtggccgagcccccagtgatttgtagccatttcgcacaggacttttctccagaacagaacatcaaagatagctttcagaaggtgacccccagacgctacggcaagtgcgaacatgaaaacttgcagctgtccaagtccgtcgacgagtgcaaggtgcagaagggtggctataatggacttaaccagtgtcttcccactacgcagtcaaagatctttcagtgcgataagtacatgaagatcttccataagttctctaacctcaacgggcataaggttcggcacacccggaaaaagcccttcaaatataaggagttcgggaagtcattctgtatcttctcaaatctgacccagcacaagatcatttgcaccagggtgaacttctacaaatgcgaggattgtggcaaggcattcaacggcagttccatcttcactaagcataagcgcatccatattggagagaaatcttacatctgtgaagaatgtgggaaggcttgtaaccaatttacgaatctgactacacataaaatcatctatacacgagacaaactctataagagggaagagtgctctaaggctttcaacctttcctctcatattaccacacacacgatcattcacactggggaaaatccttataaaagagaggagtgcgacaaagctttcaaccagtctctcaccctcactactcataaaataatccacacgcgggaaaaactgaacgagtacaaggagtgcggcaaggcctttaaccagtcgagccacctgactcggcataaaataatccacactggtgaaaagccttataagtgtgaagagtgcgggaaagctttcaaccagtccagtcacctcacccggcataaaattattcacacaggtgagaagccgtatcgctgcgaggagtgcgggaaggcctttagacagtcaagccacctcactacccacaagataatccacacgggagagaagccatataagtgtgaggaatgtggcaaggcattcaacaagtccagtcatctgactagacacaagagcattcacactggcgaaaaaccctatcagtgcgagaagtgcggcaaagcatctaatcagagctcgaacctgactgagcacaagaacattcacaccgaagagaagccctataagtgcgaggagtgcggaaaagccttcaatcagttcagtaacctaacaactcataagcgcattcataccggtgaaaaaccatataaatgtgaggagtgcggaaaagccttcaaccagagctcgattctcactacccataagaggattcatacgggagagaagagttacaaatgcgaggagtgcggaaaggccttttatagatccagtaagctcactgaacataaaaagatccatactggggaaaaaccgtacacttgtgaggagtgtggtaaagcgttcaatcattcctcacacttggccacacacaaggtcatccacaccggggagaagccttaccagtgtgaagaatgtggtaaggcctttaatcagtcctctcaccttactaggcacaagcgcatccatacaggcgagaagccttatcagtgtgaaaagtgtggtaaggcctttaaccaaagctctaatctgacaggccacaagaagatccatacaggcgagaaactctacaagcctaagaggtgtaactccgattttgaaaacaccagcaagtttagcaaacataaaaggaattatgcaggggaaaagagttag

SEQ ID NO: 25732 - DNA, 504 bp, Artificial Sequence
  Description of Artificial Sequence: Synthetic coding sequence
atgagaactcacactggcgaaaagccctacaaatgtgaggagtgtggcaaggcttttaactcctcctcaatcctcaccgaacacaaggtgatccactccggcgagaagccatataagtgtgagaaatgcgacaaggttttcaaaagattctcatacttaacaaaacacaagaggattcatacaggcgagaagccctataaatgcgaggaatgtggcaaagctttcaactggtccagcatcctcaccgaacacaagcgcatccacactggcgagaagccttacaattgtgaagagtgcggcaaggcctttaaccggtgttcccatctcacgagacacaaaaagatccatacagcagtaaaaaggtacaaatgcgaagagtgcggcaaagctttcaagcggtgcagtcatctgaatgagcacaagcgggttcagagaggcgaaaaatcctgtaagtacaagaagtgcggcgaagccttcaaccactgtagcaatctaactacatag

SEQ ID NO: 25733 - DNA, 1401 bp, Artificial Sequence
  Description of Artificial Sequence: Synthetic coding sequence
atgctggagaattaccgaaatttagtcagcttgggccttaccgtgagcaagcccgagcttatcagcaggctggaacagcgacaggagccatggaatgttaagcgtcacgagacaatagccaagccccctgcaatgtcctctcactacaccgaggatctgcttccagagcaatgcatgcaagatagcttccagaaagtaattctgcgtaggtatggtagctgcggcctggaggatttgcacctgcggaaggatggcgaaaacgtgggcgagtgcaaggatcagaaagagatttataatggcctgaaccagtgtctgagcactctcccgagcaagatctttccatataacaaatgtgtcaaagttttcagtaagtcaagcaacctcaatagggagaacataaggcacacaaccgaaaaactgttcaagtgtatgcagtgcgggaaggtgttcaaatcacactcgggcctgtcgtaccacaagatcatccacacagaggagaagctgtgcatttgtgaggagtgcggcaaaacctttaaatggttcagctatcttactaagcacaagaggatccatactggggagaaaccgtataaatgtgaggagtgtggaaaggcctttaattggtgtagcagcctgactaaacataagcgcatccataccggtgagaagccctataagtgcgaggaatgtgggaaagcgttccactggtgcagccccttcgttagacataaaaagatccacacaggcgagaaaccttacacttgtgaggactgtgggagggcctttaaccgccattctcaccttaccaaacacaagacaattcatactggcaaaaagccgtataaatgtaaggaatgcgggaaagctttcaaccattgcagcctgctgaccattcacgagcgcactcatactggtgaaaagccctacaagtgtgaggagtgcgggaaggcatttaattcaagcagcatccttaccgagcataaggtgatccacagcggcgagaaaccgtataaatgtgaaaagtgcgacaaggtgtttaagcggttctcatacctgacaaaacacaaaaggattcatacaggagagaagccctataaatgcgaggaatgcgggaaagcctttaattggtcaagcatcctcaccgaacacaaaaggatccacaccggagaaaaaccatacaattgtgaggaatgtggtaaagcttttaataggtgctcacacctgacgcggcataagaagatccatactgcagtgaagagatacaaatgcgaggagtgtggaaaggccttcaagcgatgcagtcacctgaacgaacacaagcgcgtacagaggggagagaagtcttgcaagtacaagaaatgtggcgaggccttcaatcactgcagcaatctaactacatag

SEQ ID NO: 25734 - DNA, 1401 bp, Artificial Sequence
  Description of Artificial Sequence: Synthetic coding sequence
atgctcgaaaattacaggaacttagtgagtctggggctgactgtgtccaaacctgaactgatttctagactggaacaaagacaggagccatggaatgtcaagaggcacgaaacaattgcaaagccccctgccatgtctagccactacacagaggatctcctccccgaacagtgcatgcaggacagcttccaaaaagttattctgaggaggtacggatcctgtgggctcgaggatctgcacctgcgcaaagacggagagaatgtcggggaatgcaaggaccagaaggagatctacaacgggctgaatcagtgcctttccacgcttccgtccaagatatttccttataataagtgtgtaaaggtcttcagcaagtcgtccaatctgaatagggaaaacatccgacacactacggaaaagctcttcaaatgcatgcaatgtgggaaagtgttcaagagccattcaggattgtcctaccacaagatcattcatactgaagaaaaactctgcatatgcgaggagtgcggtaagaccttcaaatggttttcctacctcaccaagcacaaacgcattcacaccggtgaaaaaccctataagtgcgaggagtgcggaaaagcatttaactggtgctctagtttgaccaaacataaacgtatacataccggggagaagccctataaatgtgaggaatgcgggaaggcgtttcattggtgctcgccatttgtacgccacaagaagatccatacaggtgagaaaccctacacgtgcgaagattgcgggagggcattcaatcggcattcccatctgactaagcacaaaacaatccacactggaaaaaagccatataaatgtaaggaatgcggtaaagctttcaaccattgttcacttctaacgattcacgagcggacccacaccggtgagaagccctataaatgcgaggaatgtggcaaggcatttaacagttcatcaattttgaccgaacataaggtgatccattccggcgagaagccctacaagtgtgaaaagtgcgataaagtgttcaagcgcttttcttaccttacaaaacacaaaaggattcacacaggcgaaaaaccgtataagtgtgaagaatgcggaaaagccttcaattggtcttccatccttaccgaacataagcgtattcacactggcgagaaaccatataactgcgaagaatgcggaaaagccttcaaccgctgcagccatctcacacgccataaaaaaatccatactgcagtaaaaagatacaaatgcgaagaatgtggcaaagctttcaaacgatgctcccatttaaacgagcataagcgcgtacaacggggtgagaaaagctgcaagtacaaaaagtgcggagaggctttcaatcactgtagcaacctgaccacctag

SEQ ID NO: 25735 - DNA, 1497 bp, Artificial Sequence
  Description of Artificial Sequence: Synthetic coding sequence
atggaacttctgaccttcagagacgtgacaattgaattttcactggaggagtgggaatttttgaaccccgctcaacagtctctctacagaaaagttatgctcgagaattaccgcaacttggtgagcctcggtttgaccgtcagtaaacccgagctgatttccagactggaacaacggcaggaaccttggaacgtcaagaggcacgagaccatagccaaaccgcctgccatgtcttcccattacaccgaggaccttcttccagagcagtgcatgcaggactcatttcaaaaagtcatcctgagacgttatggcagctgcgggctggaggacctccacctccgcaaagatggagagaatgttggggaatgcaaagaccagaaggagatctataatgggctcaatcagtgtttgagcactttgcctagcaaaattttcccttacaataagtgtgtgaaagtgtttagcaagtccagcaatctcaatagagaaaatatccggcacacgactgaaaaactgttcaaatgcatgcagtgtggaaaagtgttcaaatcacatagtggcctctcgtaccataaaattatccatacagaagagaagctgtgtatctgcgaagagtgcgggaaaactttcaagtggttttcctatttgaccaaacacaaacgcatccacaccggtgaaaagccttacaagtgtgaggagtgtggaaaagcatttaactggtgtagctcccttacaaagcacaagaggatccatacaggggagaagccttacaagtgcgaagagtgtggtaaggctttccattggtgctctccattcgtcagacataaaaaaattcatacaggagaaaaaccatacacctgtgaagattgtggtcgtgcgttcaatcgacacagccatttaacaaagcataagaccatccatacaggcaagaagccgtacaagtgcaaggagtgcgggaaggcttttaaccattgttcgctcttgactatccacgaaagaacacatacaggggagaagccttataagtgtgaggagtgcgggaaggccttcaattcctcttcaatcctcacagaacacaaggttatacactccggagagaaaccttataaatgtgaaaaatgcgataaagtgttcaagagatttagttatctgacaaagcataaacgcatccacactggcgagaagccatataagtgcgaggagtgtggaaaagccttcaattggagttccatcttgactgaacacaagcggattcacactggagagaagccttacaactgcgaggagtgtggaaaagcattcaaccgttgtagtcacttgacacggcacaagaagatccacactgctgtcaaacggtacaagtgtgaagaatgtggcaaagccttcaaacgctgtagtcacctcaacgaacacaagagagtccagaggggggaaaaaagctgtaagtataaaaaatgtggagaggctttcaaccactgctccaatttgaccacctag

SEQ ID NO: 25736 - DNA, 1515 bp, Artificial Sequence
  Description of Artificial Sequence: Synthetic coding sequence
atgaaagaagagtcagctgcgcagctgggctgctgtcatcgcccaatggccttgggtggtaccgggggatcactgagcccttctctggatttccagctctttaggggtgatcaagtgttcagcgcttgcaggccactgcccgacatggtagacgcccatggcccatcttgtgcaagctggctgtgccctctgcctctggccccagggcgatccgccttactggcatgtctgcaggacctggacctgaacctctgcacacctcaacctgccccactcggaaccgacttacagggtctccaggaagatgcgctctccatgaaacacgagcccccaggcctgcaggcctcatctacagacgacaaaaagtttaccgttaagtatccacagaacaaggacaagctggggaagcagcctgagagggcgggtgagggcgcaccatgtccagcgttctcatcccacaattcttcatcacctcctcctttacagaatcgcaagagcccctcgcctttggctttctgtccgtgtcctcccgtcaatagtatctcaaaagaattgccttttctgctgcatgctttctaccccggttacccattgctgttaccccctcctcacctgttcacatatggagccctcccttccgatcaatgcccccatttacttatgctgccccaagatccaagctaccccacgatggctatgcccagcctcctgatgatggtaaatgagctaggccacccctccgcacgatgggagactctgctaccctatcccggtgccttccaggcctcgggccaggcgcttccatcccaagctagaaacccgggtgctggagcggcaccaaccgactcgcccggattagagagggggggtatggcctccccagctaaacgggtgccccttagctcacagactgggaccgctgccctgccttaccccttgaagaaaaagaatggcaagattctctacgagtgtaatatttgtggtaagagctttggccagctctcaaatctcaaagttcacctgcgagtacacagtggagaaagacctttccagtgcgccctgtgccagaaatccttcacccagctggcacatctgcagaaacatcacttggtgcacacaggcgagcggcctcacaagtgcagcgtatgtcacaaacgattttcctcatcgtcaaatctcaagacacacctgcgtttacacagtggagcacggccattccaatgcagcgtgtgccgctcaagattcacacagcacattcatctgaaactccaccaccgccttcacgcccctcaaccctgcggtctcgtgcacacccagttacctctggcctccctggcttgcttagcacagtggcaccagggcgctttggatctgatggctgttgcctccgagaaacacatgggctacgacattgacgaagttaaagtgtctagtaccagccagggtaaagctcgagccgtaagcctaagcagcgcaggtaccccacttgtgatggggcaggatcagaacaactag

SEQ ID NO: 25737 - DNA, 507 bp, Artificial Sequence
  Description of Artificial Sequence: Synthetic coding sequence
atgaaagaagagtcagcagcgcagttaggatgttgccaccggcctatggcccttgggggaacagggggatcattaagcccgagcctggattttcagctcttccgcggagaccagtctacctctcaccaggggtgccggcctgcacccccaatgacaagaaattcccagtctagtactcatcggactcggacatcctgggagaactcccagaaagaactggctagaggacccccagctcagcccagcccacttataacagcattgccacatcacaggtgtcgaaccgaaagggccccagcaccttggctgtcagctcctgtaccgctttcaactccaagccccagatcatctcatttttcttctacaccttccactctagacactcacttctcctgtctgcaccccacctgttcaccgatgggaccatacctcctcactaatgtgccgaccagttcctgttgcccaaagaccccgccaacacccccttggctgtgtttggcatgttag

SEQ ID NO: 25738 - DNA, 1515 bp, Artificial Sequence
  Description of Artificial Sequence: Synthetic coding sequence
atgaaagaggaatctgcagcacagctgggttgttgtcaccgtcctatggcacttggtggcaccgggggatcactatctccctcattggattttcagctctttaggggcgaccaggttttctctgcctgtcggcctttgccagatatggtggatgcccacggtccctcatgtgccagctggctttgtcctttgccgctcgctcctggtcgatcagccctgttagcatgcttacaagatctggatctcaatctatgcaccccgcagccggcacctctgggaaccgatctgcaaggtctacaagaagatgccttatctatgaagcatgagcctcctgggctccaggcgtcaagtaccgacgacaagaagttcactgtgaaatatcctcagaacaaagacaagctcgggaagcaaccagagagggccggagagggcgcaccctgccccgctttctcctctcataacagtagttctcctcccccactgcagaaccggaagtcgccctcccctctggctttttgcccttgcccgccagtaaactctatctcaaaggagctcccatttttactgcacgccttctaccccggatatccactgttattgccaccacctcatttgttcacgtacggcgcactcccttctgatcagtgtcctcatctgctgatgctgcctcaagatccttcatacccgacgatggccatgccatccctgcttatgatggttaacgagctcggtcacccctccgctcgctgggaaaccctgctaccctacccaggtgccttccaggcgtccggccaagctttaccttctcaggcacggaatccaggagccggagctgccccaaccgattctcctgggttagaaaggggcggaatggcatcccccgcaaaacgagtaccgttgtcaagccagaccgggacagccgctctgccgtatccccttaaaaaaaagaacggaaagatcctctacgagtgcaatatttgcggaaaaagctttggccaacttagcaatcttaaagtccaccttcgcgtgcactccggagaaagaccttttcagtgcgctctgtgccagaaaagctttacccagctggctcatttgcagaagcaccatctggtccacaccggagaacgcccacataaatgcagcgtgtgccacaaacgcttcagttcatcaagtaatctgaaaacccacttgcgcctgcatagcggggctcgaccgttccagtgttcagtatgccggagtcgttttacccaacatatccacttgaagttacatcatcggctccacgccccacagccatgtggcctagtccacacccaactcccactggctagtttggcttgtttggcacagtggcatcagggagctttggatctgatggccgtcgcaagtgagaagcacatggggtacgatattgacgaggtcaaagtcagtagcacatctcagggtaaggccagggccgtgtccttgagcagcgccggtacacccttggttatgggacaagaccagaataattag

SEQ ID NO: 25739 - DNA, 1575 bp, Artificial Sequence
  Description of Artificial Sequence: Synthetic coding sequence
atgaaagaagagtctgccgctcagctgggctgctgccacaggccaatggcgttaggtggcactggcggatccctcagcccgtcgctggatttccagctgttccgcggtgatcaggttttctccgcctgtagaccgctgcctgacatggtggatgcccacgggccatcatgtgcgtcatggctgtgtccactaccactcgcccctggtcggtccgcactgctggcttgtctgcaagatctggatctgaatctgtgcacaccacaaccagcgccactgggcaccgatttgcaggggctgcaagaggacgccctcagtatgaagcatgaaccccctgggcttcaggccagctccacagatgacaaaaagttcacggttaagtatcctcagaacaaggataaactgggcaagcaaccagagagggcaggagagggtgccccttgcccggctttctcatcccacaattcatcctctcccccacccctccagaatcgaaagagcccgtcaccccttgctttctgcccttgccccccagtcaacagcattagtaaagaattaccttttctgctgcacgccttttaccctggttaccctttgcttttgccacctccccatttgtttacttacggcgcactgccctcagatcaatgtcctcatcttctgatgctgccacaagatcctagctaccccacaatggcaatgccgagtctgctcatgatggtgaacgaactgggacatccttcagctagatgggaaactcttctaccataccctggggctttccaagccagcgggcaggcacttccatcccaggcgagaaaccctggcgctggcgcagcgccaaccgactctccaggcctggaaagagggggtatggcatcccctgctaagcgggtgcctctgtcctcacaaaccggtacagctgcgctcccataccctctgaaaaagaaaaatggcaagatactgtacgagtgtaacatttgcggaaagagctttggccagctgtccaatctgaaagtgcatcttcgagttcactctggtgagcgcccatttcaatgtgctctgtgtcaaaagtctttcacacaactagcacacctccagaagcatcaccttgtgcatacaggcgagcgccctcataagtgctccataccttgggtccctgggaggaaccactggaagtcctttcaggcctggagagaaagagaggtgtgccacaagcgattttcttcttccagcaacctgaaaacccacttacgtcttcacagtggagctaggccgtttcagtgttccgtctgtcggagtcggtttacacagcacatacaccttaagctccaccaccggttgcatgccccacagccatgtggacttgtacacacccaactaccactagctagtctggcctgcttggctcagtggcaccagggcgctttggatcttatggctgtagcttccgagaagcacatgggctatgacatcgacgaggttaaagttagctctacttctcaaggcaaggccagggccgtcagtttgtcctccgcaggaacccccctagttatgggccaggaccaaaataattag

SEQ ID NO: 25740 - DNA, 570 bp, Artificial Sequence
  Description of Artificial Sequence: Synthetic coding sequence
atgaaggaagagtccgccgctcagttgggctgttgtcacaggcctatggcacttggcggtactggcggatctctttcacctagcctcgacttccagctatttcgaggggaccaggtcttctctgcttgtagacccctgccagacatggtcgacgcccacgggcctagctgcgccagttggctctgccctctgcctctggcacctgggaggtcagcactgctcgcctgtctccaagaccttgacctgaacctgtgtacccctcagcctgccccattgggaaccgatctacaggggcttcaggaggacgcgttgagcatgaaacacgaacctcctggcctccaggcttccagcacggacgataaaaaatttactgtgaagtacccccagaacaaggacaaattaggaaaacagcctgaacgtgcaggcgaaggcgcaccatgcccggcattttcaagccacaatagttcaagcccaccgcctctacagaacagaaaatcccccagcccattagctttctgtccctgtcctcccgtgaattccatcagtaaagagcttccttttctactttag

SEQ ID NO: 25741 - DNA, 1575 bp, Artificial Sequence
  Description of Artificial Sequence: Synthetic coding sequence
atgaaggaggaatccgcggcacagctaggttgctgccatcgaccaatggctctgggcggaacgggcggttcactcagccctagcctggattttcaactcttccggggagaccaagtgttcagtgcttgccggccactgcctgatatggtcgatgcgcacggaccatcgtgcgcatcctggctatgtcccttgcctctcgctcccggtcgatccgccctgctggcctgcttacaagacctcgaccttaatctctgcaccccacagcctgcgccattagggacagatctccaggggctgcaggaggatgcattaagcatgaaacatgaacctccaggccttcaggccagttcaaccgacgataagaagttcactgtgaagtaccctcagaacaaagataaattgggtaagcagccagagagggctggtgagggagccccatgcccagcattttcaagccacaactcctcaagtcctccaccactgcagaacagaaagtcccccagtcctctggcattctgcccatgtcctccagtgaattcaatttcaaaggaactgccttttctgttgcacgcattttaccccggatacccactcctcctccccccaccacacttgttcacgtacggagccctcccatcagatcagtgcccgcacctgttaatgctgcctcaggatcccagctaccccaccatggcaatgccttctctgctgatgatggtcaacgaacttggccatccttcggccagatgggagacgctgctcccctatccaggggcatttcaagcttctggacaggccctgccaagccaggccaggaacccaggggcaggtgccgctccgacggattcccccggtcttgagagggggggaatggcaagccctgccaagagagtgcccctaagcagccagacagggactgccgcactgccttacccattgaagaaaaaaaacggtaagattctctatgaatgcaacatctgtggcaaatcgttcggtcaattgagcaacttaaaagtacatctaagggtgcacagcggagaacgcccattccagtgcgccttgtgtcagaagtctttcacacagcttgcccacttgcagaagcaccatctggttcatacaggagaaagaccccacaaatgttctatcccctgggtgcctggaaggaaccattggaaatccttccaggcctggagagaaagagaggtgtgccacaagcggttttcaagtagtagcaatctgaagacccacctgcgactgcactcaggggcacgaccctttcaatgcagtgtgtgcaggtcccggtttactcagcatattcatctgaaactgcaccataggctgcacgctccccaaccctgcggacttgtccatactcagctgccgctggcttctctggcatgtctggctcaatggcaccagggagccctggatctcatggccgtagccagcgagaaacacatggggtatgacattgatgaggtaaaggtctcctccacgagccagggaaaggcaagagcagtatccctatcatccgctgggacccctctggtgatggggcaggatcagaataattag

SEQ ID NO: 25742 - DNA, 810 bp, Artificial Sequence
  Description of Artificial Sequence: Synthetic coding sequence
atgaaagaggagtctgccgcacagctcgggtgctgtcaccgcccaatggctctgggtggaaccggaggcagcctctcccctagcctcgacttccagcttttccgcggagaccaggtgttctccgcttgcagacccttgcctgacatggtggacgcccacggcccatcatgcgcgtcatggctgtgccccctcccacttgcccctggtcgttcagcactgctcgcctgtctgcaagatttggatctgaacctctgtaccccccagccagccccattgggcacggacctgcagggactccaggaggacgccttaagcatgaagcatgagcctccaggccttcaggcgtcctctaccgatgataagaagtttaccgtgaagtatccccagaataaggataagctaggaaagcagccggagagggccggtgaaggcgcaccgtgccctgccttcagttcgcacaacagttcgagcccccctccactccagaacagaaagagcccctccccgttggcattttgcccatgcccccctgttaattccataagcaaggagctgccatttttgttgcatgcgttctatcctggctacccgctgctcctgccgcctccacatttgttcacatatggtgcactaccttctgatcagtgcccacacctcctgatgttgcctcaagatcctagttacccaaccatggcgatgcccagcttgctcatgatggtaaacgagctaggccatcccagtgcccgttgggagactcttcttccttatcccggtgcctttcaggcaagcggacaagccctgccctcctag

SEQ ID NO: 25743 - DNA, 279 bp, Artificial Sequence
  Description of Artificial Sequence: Synthetic coding sequence
atgatcagcttccaagagagtgttacctttcaggacgtggcagtcgatttcactgccgaagaatggcagctactggattgcgccgagaggacgctgtattgggatgtgatgctcgaaaactataggaatttgataagcgttggctgcccaattactaaaactaaagtgattcttaaagtggagcaaggccaggaaccgtggatggttgagggagccaatccacacgagagctccccgggatggagcgctgtagctcagagtcaattaggcttcaagtag

SEQ ID NO: 25744 - DNA, 360 bp, Artificial Sequence
  Description of Artificial Sequence: Synthetic coding sequence
atgatctcctttcaggaaagtgtgacgttccaagacgtggcagtcgactttaccgccgaagaatggcaactgctcgattgtgccgagcggactctttattgggacgtcatgttagaaaactacagaaatctaatctccgtaggctgccccattaccaagacaaaagttatattgaaagttgagcaagggcaggaaccctggatggttgagggcgcaaacccacatgagtcttcgccagagagcagaagtgttgccaggctggagtgcagcggggcaatcagcgccagggtgcaggtcattctgttacctcagccccctgaagaacttgagctgcaggctccagccacaatgccagggtag

SEQ ID NO: 25745 - DNA, 1137 bp, Artificial Sequence
  Description of Artificial Sequence: Synthetic coding sequence
atgataagttttcaggaatccgttacctttcaggatgtggccgtggatttcactgccgaggagtggcagctgctggattgtgcagaaagaaccttatattgggacgttatgctcgaaaactaccgaaatctgattagcgtcggctgccctattactaaaacaaaggtgatattgaaagtggagcagggccaagagccctggatggtggagggcgctaacccacatgaatcatccccagagtcagactatcctctggtcgacgagccaggcaaacatcgcgagagcaaggataatttcttgaagagcgtcctgctgacttttaacaaaatccttaccatggaacggatacaccattacaacatgtccaccagcctgaaccccatgcggaaaaagtcctacaagtcttttgaaaagtgcctgcccccaaatctggatttactgaaatacaaccggtcttatactgtggaaaacgcctacgagtgctcagaatgcggcaaagcatttaagaagaaattccactttattagacatgaaaagaaccacacccggaagaaaccattcgaatgcaatgactgtggcaaagcctacagtagaaaagcccatctggccactcaccagaaaatccataatggagaacggccattcgtttgtaatgactgcggcaaggcctttatgcataaagcccagctggttgttcatcagcggctccatacaggcgagaaaccctacgagtgctcccagtgcggaaagacattcacctggaactcttcattcaatcagcacgttaaaagccacactcttgagaaatcttttgagtgcaaagagtgcggaaaaacgtttcgatactcctctagcctctacaaacactcgcgttttcacacgggggagaaaccttatcagtgcatcatatgcggaaaggcctttggcaacactagtgtcctcgtcacccaccagcggatccacaccggagagaagccgtattcttgtattgaatgcgggaaagcattcataaaaaagtcccacctgttacgacaccagataacgcatacaggcgagaaaccatatgaatgtaaccgttgcggtaaggccttctcacagaagagcaatcttatcgtccaccagaaaatccatacatag

SEQ ID NO: 25746 - DNA, 2052 bp, Artificial Sequence
  Description of Artificial Sequence: Synthetic coding sequence
atgtcgcctcatcccgaagccatcaccgactgcgtgaccttgaacactgtaggccagctggccgaagggggataccccctacgcttcagcaccttattccaggaacaacagaaaatgaatatttctcaggcaagtgtctcattcaaggacgtaactatagagtttacacaggaggagtggcagcagatggctcccgtgcaaaagaacctttatcgcgacgttatgctcgaaaattattccaaccttgtgagcgtgggctattgctgtttcaagccggaggtgatttttaagctggagcagggcgaagagccttggttctctgaggaggagttttccaaccagtctcacccgaaggactatcgtggggatgacctgattaagcaaaacaaaaagattaaagacaaacacttagagcaagctatctgcataaataacaaaacactcacaactgaggaagagaaggttctggggaagcctttcaccctgcacgtcgccgctgtggcctcgacaaaaatgagctgcaagtgtaatagctgggaggtgaatctgcagagcattagcgaattcatcatcaacaatagaaattacagtaccaaaaaaataggatgtggtaacgtgtgcgagaatagtccattcaagattaattttgagaaaacacagacaggggagaaattctacgaacataataaaaacatgaaggcactcaattataacgagaatcttcctaaacatcccaaattccaaacactggagcaggcctttgagtgcaacaaaatagggaaggcatttaacgacaaggctaattgtgtaaaacacaactccagccataccggcgagaccagctcaaaggacgacgagtttcgcaagaattgtgacaagaagacgcttttcgaccatagaaggacaggcaccggcaagaaacatctccatctgaaccaatgcggcaagtcatttgagaaaagtacggtggaggaatacaataaactgaatatgggcattaagcattatgagctcaacccatccggaaataactttaaccgaaaagcccatctcactgaccctcaaacagccgtaatcgaggaaaacccattagtatctaatgataggacacagacctgggtcaagtctagcgagtaccacgagaataagaaaagttatcaaacgtctgttcaccgagtaagaagaagaagccacagcatgatgaagccctataagtgcaatgaatgcggcaagagtttctgccagaaggggcatctcatccaacatcaaaggacccataccggggagaaaccgtttgaatgctcagaatgtggtaagactttttcccagaagagccacctgtctacacaccagcgaatccacaccgctgagaaaccatacaaatgtaatgagtgcggcaagacatttgtccaaaaaagcacactgaggggccatcagcggattcacacgggcgaaaagccgtacgaatgtagcgagtgtggcaagacattcgtacagaagtctactctgagagatcaccataggatacatacaggcgagaaaagcttccaatgcaatcagtgtggcaagacgtttgggcaaaagtcaaacctgagaatccaccagaggacgcacaccggggagaagacctatcaatgcaacgaatgtgagaagtctttctggagaaaggatcacctgattcagcatcaaaagacccacacaggggaaaagccatttaaatgtaacgaatgcggcaagaccttcgctaggacatcgacactgcgggttcatcagcgaatccataccggcgaaaaaccttttaagtgcaacgagtgcggcaagaagttcgtgcgcaaagccatattgagtgaccaccaacgaatacacaccggagaaaaacccttccagtgtaataagtgcggcaagacctttggccagaaatccaacctgcggattcatcagcggacacacagcggggagaaatcctatgaatgtaatgaatatggaaaattgtgcaagaagagtactttgagcctgtatcagaaaatccagggcgaaggtaacccctactag

SEQ ID NO: 25747 - DNA, 789 bp, Artificial Sequence
  Description of Artificial Sequence: Synthetic coding sequence
atgccccgtagcccccttagatcgtctctctccacggaggcgtctggacctaggggacccttcaaatgcccagctagtccacgaccaatcacagctcagctgctccctggaagttcccctattatcggtcggtgtgtgttgcgggtccagcgtggctttccagggcctaaacctgcattgatcagttggatggaacaggaatccgaggcctggtccccggcagcgcaggaccctgagaaaggagaacgactgggtggcgctcggagaggagatgttcccaacagaaaggaagaggagccggaggaagtcccacgtgccaaagggccacgaaaggcacctgttaaagagtcccccgaggtgttggtggaacgaaacccggaccccgctatcagtgtcgccccagctagggcgcagccacccaaaaacgccgcttgggaccctacaaccggcgcacaaccccctgcgcctatcccctccatggacgcccaggctggacagagacggcacgtttgcaccgactgcggccgacgattcacatacccttctctactcgtatcccaccgcaggatgcattcgggtgagaggcctttcccctgcccggaatgtgggatgcgattcaagcgaaaatttgccgtcgaggcccaccaatggattcaccgctcatgttcggggggacggagggggagacggcctgggatccgcgcagtccctagagccccagtacggggagatcgggacccacctgtactcttcaggcactatcccgatatctttgaggaatgtggatag

SEQ ID NO: 25748 - DNA, 1503 bp, Artificial Sequence
  Description of Artificial Sequence: Synthetic coding sequence
atggcacccccatcggccccactgcctgcccagggcccaggcaaagcaagaccctctcgcaaaagaggcaggcgccctagagctctgaagtttgtcgacgtggcagtttatttttctccagaggagtggggatgtctgaggcctgctcagcgggctttgtatcgcgacgtgatgcgtgaaacctacggacaccttggagcactgggatgcgctggacctaagcccgcactgatttcctggcttgaaagaaacaccgatgactgggagccggctgcacttgatcctcaggagtatcccagaggtttaactgttcaacggaagtcccgcaccagaaagaagaatggggagaaggaggtttttcccccaaaggaggctccgaggaaaggcaaaagagggagaagacctagtaaacctcgactcataccacgccagactagtggcggacccatttgtccagattgtggctgcacattcccagaccatcaggccttagagtcccacaaatgcgcccaaaatctgaaaaagccctatccttgtccagattgcggtcggcgttttagttacccgtccctgctggttagtcatcgcagagcccactcaggcgaatgtccatatgtatgtgatcagtgtggcaagaggttcagccagaggaaaaatcttagccagcaccaggtcattcacacaggagagaagccgtatcactgcccagattgtgggagatgcttcagaagatctagatctttagctaaccacagaacaacacatacgggagagaaacctcaccagtgcccctcatgcggcaggaggttcgcgtatccttcacttttggctattcaccagcggacccacacgggtgagaagccctatacttgcctggaatgcaatagaagattcagacagcggactgcgttggtgatacaccaaaggatccacaccggtgaaaagccatatccctgtcccgattgcgagaggcggttctcaagctcaagcagactcgtctctcaccgccgtgttcactcaggcgagcggccttacgcgtgtgaacattgtgaagcacggttcagtcagagatcaacactcctgcagcatcaacttctgcacactggcgagaaaccttacccttgtcctgattgcggaagggccttccgtcggtcgggtagtctggccatacatcgtagcactcacactgaggagaaacttcatgcgtgtgacgactgcggtcgtcgcttcgcctacccctctctgctagccagccacaggcgcgtgcattccggagaacggccttatgcttgcgacctgtgctcgaagagattcgcgcagtggagtcacttagcacagcaccagcttttgcataccggagagaagccgttcccgtgtctggaatgcggcaggtgtttccggcagaggtggagtctagctgtgcacaaatgttcgcccaaggcccctaattgttctccacggtcagcaatcggaggctcctctcaacgtggaaatgcacactag

SEQ ID NO: 25749 - DNA, 1497 bp, Artificial Sequence
  Description of Artificial Sequence: Synthetic coding sequence
atggcacctccaagcgccccacttcctgctcaggggccaggaaaggcaaggcctagtagaaaaagaggtcgcagacctagggctttgaaatttgtggacgtggcagtgtacttttctccagaggagtggggatgtctcaggccagctcaaagagcgttgtatagggacgtcatgagagagacctacgggcaccttggcgcattggggtgtgccggtcccaaacccgcactgatcagctggctggaaagaaatacagatgattgggaaccggcagccctggacccccaggagtaccccagaggccttaccgtacagcggaaatctcggacacggaaaaagaatggtgagaaggaagtttttcctcccaaagaagccccacgaaaggggaagagaggaagacggccttctaagcccaggctgatccccaggcagacgagtggcggtccaatttgcccggattgtggctgcaccttcccggatcaccaggccctcgagagtcataagtgcgcccaaaacctcaaaaagccctacccgtgccctgattgtggcagaaggttctcatacccgagcctgctggtgagccatagacgggcacatagcggcgagtgcccgtacgtttgcgaccagtgcggtaaacgcttctcccaacggaagaatctgtcacagcaccaggtgattcatacaggcgaaaagccctatcattgcccagactgtggacgatgttttcgccgatcccgaagtcttgccaatcatcgtaccactcatactggcgagaagccacatcaatgcccctcctgcggccgaaggtttgcctacccctccctacttgccatacaccagcgcacacacactggcgaaaagccatacacctgtctagagtgtaaccgtcggtttaggcagcgcaccgccctcgtgattcaccagcgaatccatacaggcgagaagccttacccatgccctgattgtgagcgcaggttttcaagctcaagccgcttagtgtcccaccgcagggttcattccggggaaaggccctatgcctgcgaacattgcgaggcaagatttagtcagcgtagcaccctcctccaacaccagctgctgcatactggggaaaagccatacccctgcccagattgcgggcgagctttccgcagatcagggagtctggccattcatcggtctacacacacagaggaaaagctgcacgcatgtgacgattgtggacgccgtttcgcctatccaagtcttctagctagccatcggagagtgcattccggcgagcggccttacgcatgcgacctgtgtagcaaaaggttcgcacagtggtctcaccttgctcagcatcagctactgcacacgggcgagaagccgtttccttgtcttgagcccgttctccctcctgaagtggtcagtgccgtccataagtgctccccaaaagcaccaaactgtagtccgcgatctgccattgggggttccagccaacgcggaaatgcacactag

SEQ ID NO: 25750 - DNA, 921 bp, Artificial Sequence
  Description of Artificial Sequence: Synthetic coding sequence
atggcgcaaatttcctccggtggcggtgggcaaagcaggtgcttactttttgccctgggtagcgagatgggctccgagaaggagcagagccctgagcctcatctgcctgaagagggagaaggcggtaaaccatggagagtagacgatagcgaaggcagctggattccaccaggcgaaaaggagcatgggcaggagtcactgtctgacgaactacaggaaacccatcctaagaagccatggcagaaggtcacagttcgggcaagggagctgggtgaccctattgcccaccccaggcatgaagccgatgagaaaccctttatctgcgctcagtgtgggaagacttttaataatacttccaacttgcggacccaccaacggattcataccggcgagaaaccgtataagtgttctgagtgtgggaagtccttttcccgctcttccaaccgaatccggcacgaacgcatccacttggaagagaaacactataaatgcccaaaatgtcaagaaagctttcggagacgctctgatctaactacccatcaacaagatcacctcggaaaacggccatatcgatgcgatatttgtggcaagagtttcagccagtccgcaacactcgctgtacatcataggacacatcttgagcccgctccttacatctgttgtgagtgcggcaagagcttcagtaactcctcctcgtttggggtgcaccacagaacgcacacaggggagcgcccatacgagtgcactgaatgcggcagaaccttcagtgacatctctaacttcggcgcacatcagagaacccatagaggagaaaagccatacaggtgtacagtgtgtggaaagcacttctctcgcagctccaacctcattcgccaccagaagacccacctcggggagcaagctgggaaagacagctcatag

SEQ ID NO: 25751 - DNA, 939 bp, Artificial Sequence
  Description of Artificial Sequence: Synthetic coding sequence
atgtcactttgctcccccacgcacagcgccgaaatgagtctcttcctgcaaggaccagaagaaatgctgcctctgtcgtcagaaggatctgagatgggcagcgaaaaagaacaaagtccagagccccacctcccggaagaaggtgagggtggcaaaccttggagagtcgatgatagtgaaggcagttggattccacctggagagaaagaacatggacaggaaagcttatcagatgaactgcaggagactcacccaaaaaagccatggcaaaaggtcaccgttcgggcacgcgaactgggtgaccccattgcgcatcccaggcacgaggccgacgaaaagcctttcatctgtgcgcagtgtggaaagaccttcaacaacacctcaaaccttcggactcatcagaggatccacacaggcgagaagccgtataagtgttcggagtgcgggaaaagcttcagccgctccagcaacagaattcggcacgagcgcatccatctagaggagaaacactataagtgtcctaagtgccaagaatcctttagacggagaagcgatcttaccactcatcagcaggatcatttaggaaagcgcccatatcgctgtgatatttgtggcaaatcttttagtcaatcagctacacttgccgttcaccatcggacccacctggagccagctccatatatatgttgcgagtgtgggaaaagcttcagcaattcgagttccttcggtgtgcaccatcggacccatacgggggaaaggccgtacgaatgcacagagtgtggaaggaccttttccgacatctccaactttggagcgcatcaacggacgcatcgtggggagaagccttataggtgtacagtgtgcggcaaacactttagcagatcaagtaacctgaaaccatttattcctctgtggcggatggtgctatatagcctgtag

SEQ ID NO: 25752 - DNA, 921 bp, Artificial Sequence
  Description of Artificial Sequence: Synthetic coding sequence
atggcccagatttcatccggtggaggtggccaatcaaggtgtctcctctttgctctgggatctgaaatgggtagtgaaaaagagcagtctcccgagccccatctgccggaggagggcgagggtggaaagccctggcgagtcgacgacagtgaggggtcttggattcccccaggcgagaaggagcacgggcaggagagcctgagcgatgagctgcaggagacccaccccaagaagccctggcagaaggtcacggtgagagcgagagagctcggagatcctattgcacatccaagacatgaagctgatgaaaaacccttcatctgcgctcaatgtggaaagacgtttaacaatacctcgaatctgaggacccatcaaaggattcacacgggcgaaaaaccttacaagtgcagcgagtgtggtaagagcttttcgcggtcttcaaacagaatccggcatgaacgtatccatcttgaagagaagcattacaaatgtccgaagtgccaggagtcctttagacggagatcagacctgactacacatcagcaggaccacctcggcaaaaggccgtaccgttgtgatatctgtggaaagtcatttagtcaaagtgctactctcgccgtgcatcacaggactcacctagagccagccccatacatttgctgtgaatgtggaaaatccttttcaaattcgtcgagcttcggtgtgcaccaccggacccacaccggcgaaagaccctatgagtgcacagagtgtggaaggactttcagtgacatttctaattttggcgctcatcaaagaactcatcggggtgagaagccatacagatgtacggtgtgtggcaagcactttagtcgctcgtccaacctgattagacatcagaaaactcatttgggagagcaagctggtaaggacagttcctag

SEQ ID NO: 25753 - DNA, 855 bp, Artificial Sequence
  Description of Artificial Sequence: Synthetic coding sequence
atggggagtgagaaggagcaatctccagagcctcatttacccgaggagggcgaagggggtaagccctggagggtggacgactctgagggctcatggattccacccggagagaaggagcatgggcaggagtccctgtcggatgagcttcaggaaacccatcccaagaagccctggcagaaagtgactgttcgggcacgtgagttaggagacccaattgctcacccacgtcacgaagctgacgagaaaccttttatatgtgcgcaatgtggaaagactttcaacaacacaagtaacctccgtacccatcagcgaattcacacaggggagaaaccctataagtgctccgaatgtggtaaatctttcagtagatcttcaaacaggatcaggcatgaacgtatccatctggaggagaagcactataagtgccccaagtgccaggagtcctttcggaggcgcagcgatcttactacccaccagcaggatcacctggggaaacgcccatatagatgtgatatctgtggaaagtccttttcccagtctgccaccctggccgttcatcaccgtacccacctggagcccgctccttacatctgctgtgaatgtggcaagtctttcagtaattctagttctttcggagtacaccaccgcacacacaccggagagaggccttacgaatgcacagagtgcggtaggacgtttagcgacatcagcaattttggggcacatcagcggacccacaggggggaaaagccctacaggtgcactgtctgcggaaagcactttagtcggagcagcaacctgatacggcatcagaaaacacatcttggcgaacaagcaggcaaagattcatcttag

SEQ ID NO: 25754 - DNA, 855 bp, Artificial Sequence
  Description of Artificial Sequence: Synthetic coding sequence
atgggcagcgagaaagagcagagtccagagccccatttacccgaagagggagagggagggaagccctggagggttgacgactcagagggtagctggatcccgcctggcgaaaaggaacacggccaggaatctctgtccgacgagctccaggagacacaccctaagaaaccctggcagaaagtgactgtgagggcccgagagctgggtgacccgatagcccacccgagacacgaggccgatgagaagccattcatatgcgcgcagtgtggcaagacatttaacaacactagcaatttgcgcactcatcagcgcattcacacaggcgaaaagccctataaatgtagtgaatgcggcaagtccttctctcgctcctccaacaggatcaggcacgagcgaattcatctggaagaaaagcactataaatgcccgaagtgccaagagtcatttaggcgaagatcagaccttacaacccatcaacaggatcacctgggcaagcgcccataccgatgtgacatctgcggcaagtcgttctcacagtccgcaacactggctgtgcaccaccgcacacatctcgagccagccccttacatatgctgtgagtgtgggaagagctttagcaattcttctagttttggtgtccaccaccggactcataccggtgagcgcccatacgagtgtaccgaatgcgggcgtacttttagcgacatttctaattttggtgcacaccagaggactcaccgaggcgaaaagccatacagatgcaccgtttgtggaaaacactttagccgatcctccaaccttataagacatcagaagacccacctgggtgaacaagctgggaaggacagctcttag

SEQ ID NO: 25755 - DNA, 855 bp, Artificial Sequence
  Description of Artificial Sequence: Synthetic coding sequence
atggggagcgaaaaggagcagtctccggagccccacttgccggaagagggcgagggcggaaaaccgtggagagtcgacgattctgaaggatcctggattcccccaggagaaaaggagcacggccaagagtccctctccgacgaattacaggagacacacccaaaaaagccatggcagaaggtgacagtgcgagctagggagctgggggatccaatcgctcaccccaggcatgaagccgatgagaagccatttatctgtgcccagtgcggcaagacctttaacaatacttccaacctgcgcacacaccagaggatacacacaggcgagaaaccatataaatgtagcgagtgtggtaaaagctttagccggagctccaaccggattcgccatgaaagaattcatctggaggaaaaacattataaatgccccaagtgccaggagagcttcagaaggcgaagcgatctcacgacccatcaacaggatcacctggggaaaagaccctaccgttgcgacatatgtggcaaatcgttttcacaaagcgccacccttgccgtgcatcaccgcactcatctggaaccggctccctatatctgctgcgagtgtgggaagtccttttcaaatagctcatctttcggggtccatcaccgcacacataccggggaacggccatacgaatgcactgaatgtggtcggaccttctccgacatatctaacttcggtgcccatcaacggacccatcggggtgagaagccttataggtgcacagtatgtggcaagcacttttctaggagttccaatttgattaggcaccagaaaactcacctcggcgagcaggctggaaaagactcaagttag

SEQ ID NO: 25756 - DNA, 402 bp, Artificial Sequence
  Description of Artificial Sequence: Synthetic coding sequence
atggctcagattagctctggaggcggaggacaatccaggtgtctgttgttcgcccttgttctggccatttgtgtgcacagtcaaggttccgaaatgggctcagagaaagagcaaagtcccgaaccgcacctccctgaagaaggtgagggaggtaagccatggcgagtggatgacagtgagggatcttggattcccccaggcgaaaaggagcacggtcaggagtccctttccgacgaacttcaggagacccatcccaagaagccctggcagaaagttactgtacgggctagggagttgggagaccccattgcccatccacgccatgaagccgatgaaaagccgtttatttgcgcccagtgtggtaagaccttcaataatacaagtaatcttcgcacccattag

SEQ ID NO: 25757 - DNA, 948 bp, Artificial Sequence
  Description of Artificial Sequence: Synthetic coding sequence
atgtctctttgcagtccaacacatagtgccgaaatgtcacttttcctgcagggcccagaagagatgctgccgctcagtagtgaagggtctgagatggggagtgagaaggagcaaagcccagaaccccacttgcccgaggagggtgaagggggaaagccttggagagtggacgacagtgaaggttcatggatcccccctggagagaaagaacacggccaagaaagtttgtccgatgaactccaggaaacccatcccaagaaaccatggcagaaagtgacggttagggccagagagcttggagaccccatcgctcacccaaggcatgaggctgacgaaaagccctttatatgtgcacagtgtggtaagacgttcaataatacttctaatctgcgcacacatcagcgaatacatacaggcgaaaaaccttacaaatgctccgagtgcggaaagtctttctcgcgctcttcaaaccggattagacacgagcgtattcatctggaggaaaagcattataaatgtcccaaatgccaggaatcctttaggcggagaagtgatctgacaacacatcaacaggaccacctagggaagcgcccttaccgatgcgatatttgtggcaaatcctttagccagagcgcaaccctggcagtacatcacagaacccacctggaacctgctccttacatttgttgtgaatgtgggaagtcattctcaaacagtagctcctttggagttcatcaccggactcacactggtgagcgaccatacgaatgtactgagtgcggcagaacattctccgatatctccaacttcggtgcccatcagcggactcacagaggggaaaaaccttaccgctgtacagtgtgcgggaagcatttctctcggtcatcaaacctgattcgccatcagaaaacccacttaggagagcaggcgggaaaggacagctcttag

SEQ ID NO: 25758 - DNA, 1560 bp, Artificial Sequence
  Description of Artificial Sequence: Synthetic coding sequence
atggctagctcgccagctgttgacgtgagctgccgcagacgggaaaagcgaaggcagcttgatgcgcgacggtcgaagtgtaggattaggctggggggacatatggaacagtggtgcctgctcaaagagaggcttggcttctctttgcactcgcagctggccaagttcctgctggataggtacacctcatccggatgcgttttgtgcgccggaccagagcccttgcccccaaaaggcctgcagtacctggtactgttgtcccacgctcacagtcgggagtgttcactggtcccaggccttagaggccctggaggtcaggatggcggacttgtgtgggaatgcagcgctggacacaccttcagttggggtccctctttgagtcctacaccgtctgaggcacccaaacccgcttccttgccccatacaactagacgaagctggtgtagcgaagcaactagcggccaggagctggccgaccttgaatcagaacacgacgagagaactcaagaggcccgtctaccacgcagagtagggccacccccagagaccttcccacccccaggagaggaagaaggggaggaggaagaggacaacgacgaggacgaagaggagatgctctccgacgcctccctctggacttacagcagcagtccagacgactccgagccggacgcccctaggctcttgccgtcacccgtgacttgcactcccaaggaaggagaaactccacctgctcccgcagccctgtcttcacctctggctgtgccagccctgtccgcgagctcactaagtagtcgagctccaccacctgcagaggtacgcgtgcagcctcaattaagcagaaccccgcaggctgcccagcagaccgaggctttggccagcaccggcagccaggcccaatctgcaccaacgccggcatgggacgaagataccgctcaaatcggccctaaacgaatcaggaaagccgcaaagagggagctgatgccatgtgattttcctggatgtggcaggattttctccaacagacaatacttgaatcaccataaaaaataccagcatattcatcagaagagctttagctgtccggaacccgcttgtggaaaatctttcaatttcaaaaagcacttaaaggagcacatgaagctgcattccgatacaagagactatatttgcgagttttgtgctcgaagctttcggacgagctccaatctcgtgattcatcgtagaatccatacgggggaaaagccccttcaatgcgagatttgtgggttcacttgtcgacagaaggcatccctcaattggcatcagagaaaacatgctgagaccgttgctgcccttcgtttcccatgcgagttctgtggcaaaagattcgaaaagcccgactctgtggccgctcacagaagtaagtcccacccagcacttctgctggcgccacaagaaagccctagtggacctttggagccgtgtccatcaatctccgctccaggccctctcgggtcatctgagggctcaagaccaagtgccagcccccaggcccctactctccttccccagcagtag

SEQ ID NO: 25759 - DNA, 1044 bp, Artificial Sequence
  Description of Artificial Sequence: Synthetic coding sequence
atggcttccagtcctgcagttgacgtgtcttgtagaaggcgagagaagagacgccagctggacgcaagaagatcgaaatgtcggattcggctcgggggacacatggaacagtggtgcttactgaaggagaggcttggtttttcactgcactcacagctggccaagttcctgctagaccgctacacctctagcgggtgcgtgctgtgtgctggccctgagcctctgcctcctaaaggattgcagtacctggtattattgtcaccctcttccctgagcagccgggcacctcctccagccgaggtaagagttcagccccaactatccaggactccccaagctgcccagcagacagaggcccttgcttcaacaggctctcaagctcaatctgctcctacccccgcttgggatgaggacacagcacaaatcgggccaaaacgcatacgcaaagcagctaaacgcgagctgatgccttgtgactttccgggatgtgggagaattttttctaataggcagtacctgaaccaccacaagaagtaccaacatattcaccagaagagtttctcttgtcccgaaccagcttgtggaaagtcatttaattttaaaaagcatctaaaggaacacatgaagctccactcggacaccagagactacatctgtgagttctgtgccaggtcattcaggactagtagtaatcttgtcatccaccggagaattcacaccggggagaagccgttacagtgcgagatttgtggcttcacttgtcgccaaaaagcttctttgaactggcatcagagaaaacacgccgagaccgtggccgcactccggtttccctgcgagttctgcgggaagagatttgagaagcccgactccgtggccgctcaccgaagcaagtcacatcctgctctgctcttggctccccaggaatcccccagtggccctttggaaccatgtccgagcatctcggctcccggtcccttagggtcttccgagggatcccgcccttctgcctctccccaggcgcctactctgctgccacagcagtag

SEQ ID NO: 25760 - DNA, 1425 bp, Artificial Sequence
  Description of Artificial Sequence: Synthetic coding sequence
atggcttccagccccgcagtagacgttagctgtagaagaagagagaaaagacggcagctggatgctcgcagatcgaagtgccgaattcgactaggcggtcacatggaacagtggtgcttgctgaaggaacgcctcggcttctcgttacattctcagctagccaagttcctcctagatcggtatactagcagcggttgtgtgttatgtgcaggcccagaacccctccctccgaaaggcctgcagtatcttgtcctcttatcccatgcccatagccgtgaatgctcactggtaccaggtttacgcggacctgggggacaggacggaggcctcgtctgggaatgtagcgccggacatacctttagctggggaccctctctgagccctaccccaagtgaggccccaaaacccgcttcactgcctcatacaactcggcgttcatggtgtagcgaagctacatcgggacaggagttggccgatcttgaaagcgagcatgacgagcgtacgcaggaggcccgactgcctagttctgaacccgatgcccctagacttcttccctccccagtgacgtgtaccccaaaggagggagagactcctcctgccccagctgcactgtccagccccttagcagtccccgcattgagcgcttcctcccttagtagtagggcaccccctcccgcagaagtaagagtacaaccccaactatcaaggactccccaggccgctcaacagacagaagcactagcctcaacgggctctcaagctcaatccgctccaactcctgcctgggatgaggatacagcccagataggcccaaaacgaatccgaaaggccgctaagagagagctcatgccctgtgattttccagggtgcggtagaatcttcagcaatcgacaatatctcaaccatcacaaaaagtaccagcacattcaccagaaaagcttttcatgccctgagcctgcctgtggcaagtcctttaacttcaaaaagcacctcaaagagcatatgaagctacacagcgatacaagggattacatctgcgaattttgcgccagatctttccgtacttctagcaacctggtgattcatcggcgtatccacactggagaaaagcctctgcagtgcgagatttgtggctttacatgccgacaaaaggcttctctgaattggcatcaacgcaagcatgccgagaccgttgctgctttacgctttccatgtgagttctgcgggaagaggtttgagaaaccagattcggtggccgcacacaggagcaagtcccacccagcccttttgctggcccctcaggaatctccttcaggcccactggagccatgtccaagtatcagtgcccctggcccacttggaagctcggaagggagcagaccatcagcgagcccacaagcccctaccctcctaccccaacaatag

SEQ ID NO: 25761 - DNA, 291 bp, Artificial Sequence
  Description of Artificial Sequence: Synthetic coding sequence
atggcctccagccctgcagtggatgtgagctgcagacgtagggaaaagcggaggcaacttgacgctcggcgatccaagtgcagaatacgactcgggggtcacatggagcagtggtgtcttctgaaggaacgcttgggcttcagcctgcattctcagctggccaaattcctcctggatagggcttgccctgccgctttgtttcatcctcaggtgtcacactttacacggacagcctgcgttacttgtggactgcgcggttcctgctcacctccacacggactgtccgaatag

SEQ ID NO: 25762 - DNA, 1425 bp, Artificial Sequence
  Description of Artificial Sequence: Synthetic coding sequence
atggcctccagccccgctgtggacgtctcgtgtaggcgcagggagaagagacggcagctcgatgccagacgttcaaaatgccgcatacggttgggaggacacatggaacaatggtgcctcctgaaggagaggctaggcttcagccttcacagccagctggccaagttcctcctggacaggtacacctctagtggttgcgtcctgtgcgcgggaccagaacccctgccccctaagggccttcagtacttggtgctgctatcccacgctcactccagagagtgctcactggttcctggactgcggggacctggtggccaagatggaggcctcgtttgggagtgcagtgcaggacacactttcagctggggcccatcgttaagccccaccccttccgaggcgccaaaaccagcctctctgccccatacaaccaggcggagctggtgttccgaggctacgagtgggcaagaactcgccgacctggaaagtgagcacgatgagcgcactcaagaagccagacttcctagctcagagcctgatgcgccacgactgctgccgtctccggtgacatgcacacctaaagagggagagacgccaccagctcctgcggctctctctagccccttggcagttcctgccctgtcagcatctagtctatcatcaagagccccaccacccgctgaggttagagtgcaaccacaactgtcgcgcacaccccaggcagcccagcaaaccgaggctctcgcaagcacggggtctcaagcacagagcgcgccaacccccgcatgggatgaggatacagcccagatcggacccaagcggattaggaaggccgctaagagagagctcatgccctgcgactttcctggctgtggcagaattttcagtaacagacaatatttgaatcatcataaaaagtatcagcacatccatcagaaatcctttagctgtcccgaaccagcttgtggaaaatcattcaacttcaagaagcacctcaaagagcacatgaagctccactctgatacgcgggactacatctgcgagttttgcgcccgatcatttaggacaagttccaacctggtgatccatcgcagaattcatacaggggaaaaaccactgcagtgtgagatctgcggcttcacctgcagacagaaagccagcctcaactggcatcagaggaaacacgccgaaacggtggctgccctccggtttccatgcgagttctgtggtaagaggtttgagaagcctgattctgtggccgctcatcgctccaagagccaccctgcgctgttgctcgcccctcaggagagccctagcgggccattggaaccttgcccaagtatttccgcgcctggcccactcggcagctccgaaggcagccggcctagcgcatctccgcaggcacctacactgctgccacaacagtag

SEQ ID NO: 25763 - DNA, 1575 bp, Artificial Sequence
  Description of Artificial Sequence: Synthetic coding sequence
atgccgcttgtgcacatggccagttctcctgctgtcgacgtttcttgcagacgtagggagaagcgcagacagctggacgcaagaaggtccaagtgtcggattaggctcggaggtcatatggagcaatggtgtctgttgaaggaacgactgggattctcgctgcattcccagctagctaaattcctgctggatcgatatactagtagcggctgcgtgttgtgtgctggtcccgagcccctgcccccaaagggcctgcagtacttggtgctgctctcacacgcacatagcagggaatgctccctggtccccggactcaggggacccggtggacaagacggtgggctggtgtgggaatgctcggctggacataccttctcgtggggtccaagccttagtcccaccccctctgaagcgccaaagcctgcttctcttcctcacaccactcggagaagctggtgttccgaggccaccagcgggcaggaacttgccgatctggagtccgaacatgatgagaggacccaggaggcgagactccctaggcgagtcggccctccgccagaaactttcccacctcccggtgaggaggagggcgaggaagaggaggataacgacgaagatgaagaggaaatgctttctgacgctagcctctggacatactccagctcccccgacgattctgagcccgacgcgcctcgcttgctaccctcaccggtgacctgcacgcctaaagaaggagagaccccacccgctcctgccgcattgagctctcctctggccgtacctgccttaagcgccagctcactctctagtagagcccctccgcctgctgaggttagggttcaaccccagctctcgagaaccccccaggccgcacagcagaccgaagccctggccagcacaggaagccaggcccagagcgctccaacccctgcttgggatgaggacactgcccagatcggcccaaagcgcatccgaaaagcggcaaagagagaactgatgccatgcgattttccaggctgtggacgaatcttttcaaacagacagtacttaaatcaccataaaaaataccagcacatccaccagaaaagtttctcttgccccgagccggcttgtgggaagagtttcaattttaaaaagcacctcaaggaacacatgaaattgcactcagatactcgcgactatatttgtgagttctgtgcccgaagcttcaggacctcttccaatctggtgatccaccggaggatccacaccggggagaaacctctccaatgtgaaatttgcggatttacgtgtagacaaaaggcatctctgaattggcatcagcggaagcacgcggaaacagtcgcggcactgcggtttccatgtgagttttgcggaaaaagatttgagaagcccgattctgtggctgcccatcggtccaaaagtcacccagctctgcttctcgctccacaagaatctccttcggggccactggaaccctgcccgagcatttccgcacctgggccacttggtagcagcgaagggagccgcccatccgcaagcccccaagccccaaccctcctgccacagcagtag

SEQ ID NO: 25764 - DNA, 399 bp, Artificial Sequence
  Description of Artificial Sequence: Synthetic coding sequence
atggcctcaagccctgccgtggatgtaagttgtcggagaagggagaaacggaggcagctggatgcgaggcgctctaagtgtcgcattagactcggcggacatatggagcaatggtgcctactcaaggaaaggttggggttcagcctgcactcccaattagctaagtttctgcttgaccgttacacctcatctggctgcgtcctctgtgcgggtcctgagcccctcccccctaaaggcctgcagtatctcgtgcttctgagccacgcccactcaagggaatgcagtctggtgcccggactccgcggaccagggggacaggatggaggccttgtgtgggaatgcagcgcgggacacacattcagttggggcccaagtctgagtcccaccccctcagagtag

SEQ ID NO: 25765 - DNA, 1548 bp, Artificial Sequence
  Description of Artificial Sequence: Synthetic coding sequence
atgggcctgctagccttccgtgacgtggctctcgaattcagccccgaggagtgggagtgcctcgatccagcccagcgatctttgtacagggacgtcatgttagaaaactacagaaacctaatctcgttaggtgaggattcattcaatatgcaattcctgtttcattcactagccatgtctaagccggaactaataatctgcttggaggcacgaaaagagccctggaatgtgaacacagagaaaacggcgaggcattcagtactgagttcatacctgacagaggatattcttccagaacagggcctgcaggtgagctttcagaaagtgatgctaaggagatacgagcgttgttgtctcgaaaaactaagactccgcaatgattgggaaattgttggggaatggaagggacagaaggcctcctacaacgggctggacctctgttcagccactacccactcaaagaacttccagtgtaacaaatgcgtcaaaggcttcagcaaattcgcgaaccttaataagtgtaaaatttcacatacaggggaaaaacccttcaagtgcaaagagtgcggcaatgtgagctgcatgtctctgattatgacacagcagcagcggatccatatcggggagaatccttaccagtgtaagaagtgcggcaaagcgtttaacgagtgcagctgttttacggattgcaaacgaatccatgtaggcgagaagcactgtaaatgtgaagaatgcaacaacatatttaagtcgtgcagctctcttgccgtggtggaaaaaaaccacaccgaaaagaagacttacaggtgtgaggagtgcgggaaggccttcaatctgtgttccgtcctgaccaagcacaagaagattcatacaggcgaaaaaccttataaatgtgaggaatgtggaaagtcattcaaactgtttccatatctgacgcagcacaaacgaatccattcacgggaaaagccttacaaatgtgaggagtgtggcaaagtgttcaagcttctgagctacctcacacaacaccggaggattcacactggtgagaaaacgttcaggtgcgaggagtgtggcaaggccttcaaccagagttcccatttgaccgaacatagacggatacatactggcgagaaaccttacaagtgcgaagagtgtggcaaggcttttacctggtttagttatttgatccagcacaagcgaattcacaccggtcagaaaccctataagtgcgaagagtgcggcaaggccttcacttggttctcctaccttacacagcacaagcgcattcacactggtgagaagccttacaagtgcgatgagtgtggaaaagctttcaactggtttagctacctgaccaaccacaaaagaatccatacaggcgagaaaccctataagtgtgaggagtgtggaaaagcctttgggcagtccagccatctcagcaaacacaaaaccatacacacacgagaaaagccctacaaatgcgaagagtgcgggaaagcattcaaccactccgcccagcttgcggtgcacgagaagacacatacttag

SEQ ID NO: 25766 - DNA, 519 bp, Artificial Sequence
  Description of Artificial Sequence: Synthetic coding sequence
atgggacttctggctttccgtgatgtggcactggaattcagtcctgaggaatgggagtgcttagatcctgcgcagcggtctctgtaccgagatgtgatgctggagaattaccgcaatctgatctctctcggcgaggatagttttaatatgcagttcctgtttcatagtctagccatgtcaaaacccgaactgatcatctgcctagaagccaggaaggagccatggaacgtgaatactgaaaaaacggcgcgacactccgtgctctccagttacctgacggaagacattctcccggaacagggactacaagtttctttccagaaggtgatgctccgccgatacgaaagatgctgcctggagaagcttcgactgcgcaacgattgggagataccatgcgaagacgtgttggcctcccccttgccaagcgctatgatactgtccttcctgcggcctcctcagaaacagaaacacgtcaagcccaccgagcccatacagagcaagactctccagtggctctag

SEQ ID NO: 25767 - DNA, 519 bp, Artificial Sequence
  Description of Artificial Sequence: Synthetic coding sequence
atgggcttgctcgctttccgcgacgttgccttagaattctctccagaggaatgggaatgcttggatcctgcccagcggagtctgtacagagacgtaatgctggaaaattatcgaaatcttatatcattgggcgaggatagcttcaatatgcagttcttgttccactcattagccatgtccaagcccgagctgatcatttgcctggaggcccgtaaggagccgtggaatgtgaataccgagaaaaccgcaagacattcggtactgtcctcttacctcactgaggacattcttcccgagcaaggactgcaggtaagttttcaaaaagtgatgctgagaagatacgaaagatgctgtttggagaaattacggctacgaaacgattgggaaataccttgtgaggatgtgctggccagtccattgccctcagcgatgatattgtcctttttgagaccacctcagaaacagaaacacgtgaagccgacagaacctgtccagtccagtactatagaactcttgtag

SEQ ID NO: 25768 - DNA, 1125 bp, Artificial Sequence
  Description of Artificial Sequence: Synthetic coding sequence
atggagccagggggtgaacctactggagctaaagaaagtagcactctgatggaatcactggccgctgtgaaagcagcgttcctggcacaggccccttcagggagcaggtctgccgaagtgcaggctgcacagagcactgagcctgcagctgaggcgggtgctcccgaaggagagggtcatagaggcggaccccctcgtgccttgggatccctggggctttgcgagaaccaggaggccagggagcgccctggtgggtcacccaggggaccagttacatctgagaagacaggtgggcagagcggccttgagtcagatgttccccctaacgctggaccaggtgcagaaggtgggggatcatggaaggggaggccgttcccctgtggcgcttgcgggaggagttttaaatgctcctccgacgccgctaagcacaggtcaatccacagcggcgagaagccttacgaatgcagcgactgtggcaaagcctttatccattccagtcatgtcgttcgccatcaacgggcacacagtggagagaggccttatgcttgcgcagagtgcggtaaagccttcggccaatcatttaaccttctgagacatcagagagtgcacaccggcgaaaagccctatgcatgcgcagactgtggaaaggccttcgggcagaggagcgatgccgcaaaacaccggaggacccacacaggagagcgactgtatgcctgcggcgagtgcgggaaacgattccttcattcatccaacgtggtgcgccataggcgaacccaccatggggagaacccctatgaatgcagggaatgtggtcaagccttttctcagtcctctaacttactccagcatcagcgggtacataccggagagaggcccttcgcatgccaggactgcggcagggccttctctagatcctccttcctgagagaacatagacgcatccacaccggtgaaaagccacaccagtgtgggcattgtggcagggcattccgcgctctatcagggttttttcgccaccagcggttgcataccggggagaagccatttagatgtactgagtgtggtagagcctttcgactcagttttcacttaatacagcacaggcgggtgcatggagcagagtag

SEQ ID NO: 25769 - DNA, 324 bp, Artificial Sequence
  Description of Artificial Sequence: Synthetic coding sequence
atggagcctggcggagaaccaactggggcaaaggaatcttcaacgctgatggagagtctcgcggcagtgaaggcagccttccttgcccaggctccttctgggagccgaagtgcggaggtccaggctgctcagtccaccgaacccgctgccgaggcaggagctcccgaaggcgaggggcaccggggaggacctccccgtgcactggggtctttgggactctgtgaaaatcaggaagccagagagcggcctggtggcagcccacggggaccagtgacttctgagaaaacaggcggtcagagtgggttggagtcagacgtgccctag

SEQ ID NO: 25770 - DNA, 615 bp, Artificial Sequence
  Description of Artificial Sequence: Synthetic coding sequence
atggagccgggtggggagccaactggggcaaaggaaagctccactctgatggagtccctggccgcagtcaaagcagcatttctcgcgcaagcaccgtccggttcgagatcagccgaagtacaagccgcacagagtacagagcccgctgccgaagccggagcaccagaaggtgagggacatcgtggtggcccacccagagccttaggatccctgggtctgtgtgaaaatcaagaggcaagggaacggccagggggaagtcctagggggcctgtgacaagcgagaaaacagggggacagagcggcctagaaagcgatgtacccccaaacgccggtcccggagcagagggcggaggctcctggaaaggcagaccatttccttgcggtgcctgtggaaggtcctttaagtgttcttcggacgccgctaagcaccgcagcattcactccggcgaaaagccgtacgagtgtagtgactgtggtaaagcatttattcattctagccacgtcgtgcgccatcaaagggctcactctggagagagaccttatgcctgcgcagaatgtgggaaggccttcggccagtcattcaatctcctacgccatcaaagggtccacacttag

SEQ ID NO: 25771 - DNA, 1638 bp, Artificial Sequence
  Description of Artificial Sequence: Synthetic coding sequence
atgaagcaagaagataaccagggcgtttgcgcccatcaggatagtgaggataaagggatgggttccgatttcgaggactccgaggatcgagaaggagacccggaagaacgggaaatggggtccaatccacacgacacaaataaacgagaggggcacccagaaccagaaatgggatcaaaccctcaagacagtagacatagagaggcagtacctgacatttgtaccgagggacagctaagtgaagaggaaggcgtctccgtgcggggagaggaagatgatcagtctggagtggccgacatggcgatgtttcctggcttaagtgaaagtgatagtatctctcggagcctgcgcgaagatgacgacgagtcggcaggtgaaaaccgcctggaagaggaagaggaacagccggcaccccctgttctcccctggagaagacacctatcattgggaagtcggcacagaggagataagccagcgcatcgtaggttccatcggctgcatcatccgatggctgtggatctgggggaacttgatagtctggtggcctccattatggacgcccctacaatctgccccgactgcggcgaatctttttcacctggcgcagcatttttacagcaccagcggatccaccgcctggccgaagcagctgcagctgcgagcctggaaccattcgggctggcaggtgaatgcgacgccatggtcggcatgatgggagttggtgtggccggaggcttcggagcgggtccgccactggcgaggccaccaagagaaaagccctttagatgtggagagtgcggaaaaggcttctctcggaacacttacctgacaaaccacctgcgtctccataccggagaacggcctaatttgtgtgctgattgcggaaagagttttagctggagagcagatctcctcaagcataggcgactccacacgggagaaaagccatacccttgtccagaatgtggtgaggcgttttctttaagcagccacctgttgagccacaggcgagctcatgccgcagcatccggagccggagctgcagcactaagacctttcgcatgcggggaatgtggcaagggcttcgtaagaaggagtcacctcgccaatcaccagagaatccatacaggggaaaaacctcacggatgcggcgaatgtggaaagagattctcttggaggtcggacctggtgaagcaccagcgtgtgcacactggtgagaagccctatatgtgctctgagtgcggcgaaaccttcagcgtgtcatctcacctatttacccacaaaagaacacacagcggtgagcggccttatgtgtgtcgcgaatgtgggaaagggttcggtcgcaattctcacttggtcaatcatttaagagttcacacaggcgagaagccctttcgatgtggtcagtgcgaaaagagattttcagacttttccacactgactcagcatcagcggacacatacgggtgagaagccttatacttgcatagagtgcggcaaatcgttcattcagagctctcatttaatccgacaccggcgaattcacaccggaaataagccacacaaatgcgcaggatgcggtaaggggttcagatacaaaacccacctcgctcagcaccaaaaactccatttgtgctag

SEQ ID NO: 25772 - DNA, 1929 bp, Artificial Sequence
  Description of Artificial Sequence: Synthetic coding sequence
atggaagaagagaggaaaacggccgaactccagaaaaatcgtatccaggattccgtggtgtttgaggacgtcgctgtggactttactcaagaagaatgggctcttctcgatctagcacagaggaacttgtatagagatgtcatgctggagaatttccaaaacttagcttcactcggctatccattgcacacaccccacctaatctcgcaatgggaacaggaggaggacctgcaaactgtcaagagggaactcatccagggcatttttatgggagagcatagagagggcttcgaaacgcagctgaagactaacgaaagtgtcgcctctcaggacatctgtggcgaaaaaattagcaacgaacagaagattgtgaggtttaagaggaacgattcatggttttcctcactgcacgaaaatcaggaatcttgtggcattgactatcagaataaatcacacgaaaggcacctgcgaaaccacatggtggagaatatttatgagtgctacgaagaaaaccaggacgggcagaccttctcccaagttcctaacctcgactcgcttaagcggaacacagaggtgaaatcgtgcgagtgccatgagtgcggcaaggccttcgtagaccacagtagcttaaaaagtcacatcagaagccacaccggatccaagccctatcagtgtaaggaatgcggcaaggcttttcacttcctggcatgtttcaagaagcacatgaaaacaccaacagaggaaaaaccctatgaatgtaaggagtgtactaaagccttctcctgtagcagttttttccgagcccacatgaaaatccacattggcaaaaccaactacgaatgcaaggaatgcggaaaggggttcagctgtagtagttcacttacggagcacaaaagaatccacagtggtgacaaaccttacgaatgcaaggaatgcggcaaggctttcagctgttcaagctcattatcaaagcataagcgaatccactcaggcgacaaaccatatgaatgcaaggaatgcggaaaggcattttcaagctcttcccaccttatcatacacattagaatccataccggggagaaaccttacgagtgtaaagaatgcggcaaggcatttagcgaatcttcgaagctgacagtccatggacgtactcacacaggcgagaagccctacaaatgcaaggagtgcgggaaggcgtataactgtcctagttccctgtcaattcacatgagaaaacataccggagaaaaaccttacgagtgcctcgaatgtggaaaggccttttatttgcctacatccctgaatacccacgtgaagaaccagtccagggaaaaaccgtacgagtgcaaagaatgtggtaaggccttttcatgtcctagctcctttagagcacacgtgagggatcatactggaaaaatccagtacgagtgtaaggaatgcggtaaaactttttctcgttctagtagcctgacggaacaccttcgaacgcatagtggggagaagccatatgagtgcaaggagtgcggcaaagcgtttattagctcgagccatttaaccgtgcacatcagaacacataccggggagaagccatatgaatgcaagaaatgtggcaaagcctttatctatccaagcgcactcaggatccatatgagaacccatactggcgagaagccttacgaatgcaaggagtgcggtaaggccttcagacatagctcatatctgaccgtccacgcccgaatgcacacaggcgaaaagcctttcgagtgtcttgaatgcggcaaggcattcagttgcccatctagctttcggcgacacgtccgcagccatacgggggaaaagccttatgagtgtaaagagtgtggcaaagcttttgtgtgcccggcttactttcggcgtcacgtgaaaacacacacacgggaaaacatctag

SEQ ID NO: 25773 - DNA, 2229 bp, Artificial Sequence
  Description of Artificial Sequence: Synthetic coding sequence
atgccgtgctgttcccatcgcagttgccgggaagacccgggaacatccgaatcccgagaaatggaccctgtggccttcgaggacgtggcggttaatttcacccaagaagagtggactctcttggacatctctcaaaagaatctctttagagaggtcatgctggagactttccggaacctgacaagcatcgggaagaaatggtctgatcagaatatcgaatacgagtaccagaaccctcggaggagtttcaggtcgctgatcgaagagaaggtgaatgaaatcaaagaggatagccattgcggcgaaacattcacacaggtgccggacgaccggctgaactttcaagaaaagaaggccagccccgaagtgaagagctgtgattccttcgtatgcgccgaagttggcattgggaacagctcatttaacatgtccatccgaggggacactggccacaaggcctatgagtaccaagaatacggtccgaaaccctacaagtgccaacagccgaaaaataaaaaggcattccgctatcgcccatccattcgcacccaggaaagggaccacaccggggaaaagccatatgcatgcaaagtctgtggcaagactttcatattccacagcagcattagaagacacatggttatgcactcaggggacggcacttacaaatgcaagttttgcgggaaggcctttcacagcttctcactttaccttatccatgaaagaacacacactggggagaagccgtatgaatgcaagcaatgcggtaaaagcttcacttactcggcgacactgcaaatacacgaaaggacccacaccggtgagaaaccatatgaatgctccaagtgcgataaagcctttcattcttctagctcatatcacagacacgagcgtagccacatgggagagaagccatatcaatgcaaggaatgcggaaaggcttttgcgtacacctccagcctcaggaggcatgaaaggactcattctggaaagaagccttatgaatgtaagcaatatggagagggattgagttacttaatctcattccagacgcacatcaggatgaattcaggtgaacgcccttacaagtgtaagatctgtggaaagggcttttactcggcaaaaagcttccagacccatgaaaaaacacatacaggcgaaaaaaggtacaagtgtaaacagtgtggaaaggcctttaacctatcttcgagcttcaggtatcacgagaggatccacactggcgagaagccctatgagtgcaagcaatgtggaaaagcatttcgctccgcatctcagctcagggtccacgggggtacacacacaggcgagaagccatacgagtgtaaggaatgcggaaaggcttttcgcagcacaagtcacctgcgcgtgcatgggagaactcacactggagagaagccctacgagtgtaaggagtgtggcaaggccttcagatacgtgaagcatctgcagatccacgagcgcactgagaagcacatccgtatgcccagtggagagcgcccatataagtgttccatttgcgagaagggcttttacagcgccaagagtttccaaacacatgaaaagactcacaccggggaaaagccatatgagtgtaaccagtgcgggaaggccttccggtgctgcaattctctccggtatcatgaacgtacacacactggcgaaaagccttacgagtgtaagcagtgtggaaaggctttccgttccgcttctcacctccgcatgcatgagaggacacacacaggagaaaaaccatatgagtgcaagcagtgcggtaaggccttctcatgtgcttctaacctgcggaagcacggaagaacccacaccggcgagaaaccatacgaatgcaagcagtgtggcaaggctttcaggtccgccagcaacctacagatgcatgaaaggactcacaccggcgagaagccttacgagtgtaaggaatgtgaaaaagccttttgcaaatttagttcctttcaaatccacgaacgcaaacacagaggggaaaagccgtacgagtgcaaacattgtgggaacggctttacgtccgccaagatcctgcaaatacatgcaaggactcatatcggcgagaagcactacgaatgcaaggagtgtggcaaggcattcaactacttcagcagcctgcacattcacgctaggacccacatgggcgagaaaccttacgaatgcaaggactgtggaaaggcctttagttag

SEQ ID NO: 25774 - DNA, 1596 bp, Artificial Sequence
  Description of Artificial Sequence: Synthetic coding sequence
atggggttcctgcacgtcggccaggacgggctggagctgccaacaagtggcgatccccctgcatcagcctctcagtccgcaggaattacaggcgtgtcccaccgaacacagcctccctgcttcgaaggcctcaccagtaaagatctggtgcgcgaggagaagacacggaaacggaaacgaaaggcaaaagagagtggcatggccttactccagggtctacttaccttcagagacgtggccattgagttcagccaagaggagtggaaatgcctggaccctgcccagcgaacactctacagagacgtgatgctagaaaattatcggaaccttgtaagtcttgatacctcttccaaatgcatgatgaagatgttttctagcaccgggcaggggaacacggaagtcgttcataccggcactctgcagatccacgcatctcatcacattggcgatacctgttttcaagaaattgaaaaggacatccatgactttgtctttcagtggcaggagaatgagactaacggacacgaggcgctgatgacgaagactaagaagctgatgagtagcacggagagacatgatcagcggcatgccggaaacaagccaattaagaatgagctcggttcatccttccattcacacctgcccgaggtccatattttccatccggagggcaagattgggaaccaggtggaaaaggcaatcaatgacgcctttagcgtatccgcctctcaaaggattagctgccgtcccaagaccagaatcagcaacaaatatcgaaacaactttttgcagagtagcctcttaactcagaagcgggaagtccatacgagagagaagtcatttcagaggaatgagagcgggaaggcatttaacggcagttccttactgaaaaagcaccagataatccacttaggcgataagcagtacaagtgcgacgtctgtggcaaagactttcaccagaaaaggtacttggcttgtcaccgatgccacacaggggagaatccctacacctgcaacgagtgcgggaagacattcagtcataatagcgctctcctcgtgcataaggcaattcatactggagaaaagccttacaaatgcaacgagtgcgggaaagttttcaatcagcagagtaacctggctcgccaccatcgcgtacacaccggcgaaaagccctacaagtgtgaagaatgtgataaagtcttctcaaggaagtcccacctggagcggcaccgaaggatccacaccggggaaaagccttataagtgtaaagtctgcgacaaagcgttccggagagattcccacttggcgcagcacactgttatccacacaggtgaaaaaccctataaatgcaatgaatgcggcaagacttttgtgcagaattcttctctggtgatgcacaaggtgattcacaccggtgagaagcgctacaagtgtaacgaatgtggaaaggtgttcaatcacaaatccaacctcgcttgtcaccggcgtttacacacaggggagaagccctataaatgcaacgaatgcggtaaggtgtttaatcgcaagagtaatctagagagacatcataggctccataccggtaagaaaagttag

SEQ ID NO: 25775 - DNA, 1398 bp, Artificial Sequence
  Description of Artificial Sequence: Synthetic coding sequence
atggccctgctccagggcttacttacgtttcgggatgtggcgatcgagttttctcaagaggaatggaagtgtctagaccctgcccagcggacactctaccgggatgtgatgctggaaaactatcgcaacctcgtgtcactcgatacctcgtctaagtgcatgatgaaaatgttctcatccacaggacagggcaacaccgaggtcgtgcacaccgggacactacagattcacgcctcacaccatatcggcgatacctgcttccaggaaatcgagaaggacatccatgattttgtgttccaatggcaagagaacgagaccaacgggcatgaagccctgatgaccaagaccaaaaaattgatgtcttccacagaaaggcacgaccagcgccacgcagggaataagcccatcaagaacgagctgggatcctccttccattcccacctgccagaggtacatatctttcaccccgagggtaaaataggaaatcaggtcgaaaaagctataaatgatgccttttccgtcagcgcttcgcagcggatatcctgtcggccaaaaactcggatcagtaataagtaccgcaataatttcctacagtctagtttattaacgcagaagcgcgaggtccacaccagagagaagtccttccagaggaacgaaagtggcaaggcctttaatgggtcctctctgctcaagaagcaccagatcatacatctcggcgataagcaatacaaatgtgatgtctgcggcaaagatttccatcagaagcgctacttagcatgccatcggtgtcataccggcgagaacccctacacatgtaatgaatgtggcaagactttttctcataatagtgctctccttgtgcacaaggccattcatacaggcgagaagccctacaagtgtaatgagtgtgggaaggtgtttaaccagcagtctaacctggctaggcaccatcgcgtccacactggagaaaaaccttacaagtgtgaggagtgtgacaaagtgtttagtagaaaaagtcacttggagagacatcgcagaatacacaccggtgagaagccatataagtgcaaggtgtgtgataaggcctttcgcagagattcacatctcgctcagcacaccgtgatccacaccggtgagaagccttacaagtgcaatgaatgtggcaagacctttgtgcagaacagttctctcgtaatgcataaagtcattcacacaggggagaaacggtacaaatgcaatgaatgtggtaaggtgttcaaccataaatcgaatcttgcttgccatagacggttacacactggtgaaaagccgtataagtgcaatgagtgtgggaaggtttttaataggaagagtaacctggagagacaccatcgccttcacaccggtaagaaatcttag

SEQ ID NO: 25776 - DNA, 1596 bp, Artificial Sequence
  Description of Artificial Sequence: Synthetic coding sequence
atgggctttctacatgtagggcaggatggactagagctacccacgagcggagacccaccagcctcagccagtcagtcagccggaatcactggggtctcccatcgcactcagcctccctgcttcgaggggttgaccagtaaggacctggtacgcgaggagaaaacaaggaaaagaaaacgcaaggcaaaggaatcaggcatggcgctcctgcagggcctcttaacctttcgcgatgttgcaatcgaattttctcaggaagagtggaaatgcttagacccggcacagaggacactctatagagacgtcatgctagagaactaccgcaatcttgtgtctctggacacctcctcaaagtgcatgatgaagatgttctctagtacagggcaagggaatacagaagtggtacataccggtacgctgcagatacatgcctcccatcacattggcgacacatgcttccaagagattgagaaggacattcatgattttgtatttcagtggcaagagaatgaaacaaacggacacgaggccttgatgacaaaaacaaaaaaacttatgagctccactgagcgccatgatcagcggcacgccggtaataaaccaattaaaaatgagctgggctctagctttcactctcacctgcccgaggtacacattttccacccagaaggtaaaatcggcaaccaggtagagaaggcgataaacgacgcgttctcggtctccgcaagtcaacgaatatcatgtcggccaaaaacacgcatatcaaacaagtaccgcaataatttccttcagagcagccttctcacccagaaaagagaggttcacacacgggaaaaatccttccagcgaaacgagtcaggtaaagcctttaacggttccagcctccttaaaaagcatcaaataatacaccttggcgataagcagtataagtgcgacgtgtgcggcaaagacttccatcagaagcgctacttggcctgtcatcgctgtcacacaggcgaaaatccatatacatgcaatgaatgtgggaagacgttcagccataatagtgccctgctagtgcataaagcaatccacactggtgagaagccctacaagtgtaacgaatgtggcaaggtctttaaccagcagtctaatttggcaagacaccatcgggtccataccggcgaaaaaccctataagtgtgaagagtgcgataaggttttctcaagaaaatctcatcttgaaagacaccggaggattcacaccggggaaaaaccctacaagtgcaaagtctgtgataaagctttccggagggattctcacctggcgcaacacaccgttatccacaccggggaaaagccttataagtgtaatgagtgtggaaagactttcgtgcagaatagcagtctcgtgatgcataaagtaatccatacaggagaaaagcgctacaaatgtaacgagtgtgggaaggtgttcaatcataagtctaatttggcttgccacagaaggctgcatactggagagaagccgtacaaatgcaatgaatgcggcaaggtgttcaatcggaagtcaaacctcgagcggcaccaccgcctgcacaccggaaaaaagagctag

SEQ ID NO: 25777 - DNA, 903 bp, Artificial Sequence
  Description of Artificial Sequence: Synthetic coding sequence
atgcactccctcaagaaggtgacattcgaggacgtggccattgacttcacgcaagaagagtgggctatgatggacacctccaagcgaaaactgtatcgagacgtgatgttggagaacatatctcacctggtttccctcgggtaccagatttcaaaaagctatattattctacagctggagcaggggaaagagctttggagggaagggcgtgagttcctccaagaccaaaatccagatagagaatctgctttgaagaagaagcacatgatttctatgcatccaataacccggaaagacgcctcaacaagtatgacgatggagaattctctgatattggaggaccccttcgagtgcaatgattccggggaggactgcactcacagcagcacgattacacagcggttgctaacacatagtggtaagaagccttacgtgagtaagcagtgcggaaaatctcttagaaaccttttcagtccgaaaccccacaaacagatccacacaaaaggcaaatcttatcagtgtaatctctgcgagaaggcgtacacgaattgctttcgactacggaggcataaaatgacgcatacaggagaaaggccgtatgcatgccacctttgtggcaaagcattcactcagtgtagccacttaaggcggcacgaaaagacacacactggtgagcgtccttataagtgtcaccaatgcggaaaggccttcattcagtcctttaatttgcgcaggcatgaacggactcatttaggaaagaaatgctatgagtgcgacaaatccggcaaggccttctcccagtccagcggattcagggggaacaagatcatacacacaggcgagaaaccacacgcttgccttctgtgtgggaaggcctttagtctgagttccgacttgaggtag

SEQ ID NO: 25778 - DNA, 624 bp, Artificial Sequence
  Description of Artificial Sequence: Synthetic coding sequence
atgcattccttgaagaaggtcacattcgaggacgtagccattgatttcacacaggaagaatgggcaatgatggacacttccaaacgaaaattatatcgagacgtcatgctggaaaacatttcccatctcgtgtcactgggttatcagatttctaagagctacattatccttcagctcgagcaggggaaggaactctggcgcgaaggcagagaatttctccaggaccagaatcccgatcgtgagtcggctctgaagaagaagcacatgattagtatgcatcctattaccaggaaagatgcctctacctcaatgactatggaaaactcgttaattctggaagacccatttgaatgcaacgattccggggaggactgtacccatagcagcaccatcacccagagattgctgacgcacagcggaaaaaagccatatgtttccaagcagtgcggtaagagtcttcggaatctgttcagccccaagcctcacaagcagattcatacaaaaggaaaatcttatcagtgtaacctctgtgaaaaggcctatactaactgctttcgtttacgcaggcacaaaatgacccataccggtgagaggccatacgcgtgtcacctgtgcggtaagtag

SEQ ID NO: 25779 - DNA, 234 bp, Artificial Sequence
  Description of Artificial Sequence: Synthetic coding sequence
atgcacagcctgaaaaaagtgactttcgaagatgtggctattgactttacacaggaagaatgggcaatgatggacacctccaaacggaagctgtacagagacgtgatgctggagaatatcagccaccttgtctcattgggatatcagatctctaagagctacatcattctgcagcttgaacagggtaaagaactgtggcgcgagggaagagaattcctacaggaccagaattag

SEQ ID NO: 25780 - DNA, 903 bp, Artificial Sequence
  Description of Artificial Sequence: Synthetic coding sequence
atgcattcactggagaaagttaccttcgaggacgtggctatcgactttacgcaagaggaatgggatatgatggatacttccaaaaggaaactgtatcgggacgtgatgttggaaaacataagccatctggtctccctgggataccagatttccaagtcctatatcatcctgcaactggagcaggggaaagaactctggagggagggcagggtgttcttacaggatcagaaccctgaccgggagtccgctctgaagaagaagcatatgatatcaatgcacccaataattcgtaaagacgcaagcacaagtatgacaatggaaaactcactaattctggaagacccatttgagtacaatgacagcggggaggattgcacacattcatccactatcactcagtgccttctgacacacagcggtaagaagccctgcgttagtaaacagtgtggaaaatctctgagaaatctcctcagtcccaagccaaggaaacagattcacaccaaggggaagtcctaccagtgcaatctctgcgaaaaggcctacaccaactgcttttacctgcgacgtcataagatgactcatactggtgaaagaccttacgcatgtcacttgtgtggaaaggctttcactcaatgctctcatctgcgcaggcacgaaaagactcatactggcgagcggccttacaaatgccaccagtgtggcaaggctttcatacagagttttaatctgagaaggcacgaacggacccatctggggcagaagtgctatgaatgtgacaagagcggtaaggcgttttcacagagctctggattccgtggcaataaaataatccatatcggagagaagccgcacgcttgtctattgtgtggtaaggcattctccttgagcagcgatctgagatag

SEQ ID NO: 25781 - DNA, 1116 bp, Artificial Sequence
  Description of Artificial Sequence: Synthetic coding sequence
atggacatggcccaggaaccagtcacattcagagacgtcgcaatctacttcagccgggaggagtgggcctgtctcgagcccagccagagagccctgtatagagatgttatgctcgacaacttctcctccgtggctgctcttggtttctgtagcccccgaccagacttggtgtccaggctggagcagtgggaggagccatgggtcgaggatagggagaggccagagttccaggccgtgcaaagaggacctcggccaggcgctaggaaaagtgcagaccccaaaagaccgtgcgatcacccagcctgggctcataagaagacacatgtgaggagggagagagcgagggagggatctagcttccgcaaggggttccggttagataccgatgacgggcagctccccagggctgcccctgagagaacagatgccaaaccaaccgcatttccttgtcaagtgttgactcaaagatgcggtcgacggccaggaagacgcgagcgtcgcaagcaaagagccgtggagctgtccttcatctgtggaacatgcgggaaggcattatcttgccattctaggctcctggctcaccagacagtacataccggtacaaaagccttcgagtgtccagaatgtggccaaactttcagatgggcttctaacctccagcggcatcagaagaaccacacacgcgagaagcccttttgctgtgaggcgtgcggacaggccttcagcctaaaggaccgcctggctcagcaccggaaggtgcataccgagcatcgaccttatagctgtggagactgcggcaaagcttttaagcagaaaagcaatctcctgaggcaccagctcgtgcacaccggcgagcgtcccttttactgcgctgattgtggaaaagcttttagaacaaaggaaaatctatcacatcaccagagagttcattcaggagagaaaccatatacttgtgccgaatgcggaaagtcatttcgttggcccaaagggttctccattcatagaagactccacctcaccaaacgcttttacgaatgcggtcattgtgggaagggatttcgccacctcggcttcttcacccgacatcagcgaacccataggcacggggaggtctag

SEQ ID NO: 25782 - DNA, 1116 bp, Artificial Sequence
  Description of Artificial Sequence: Synthetic coding sequence
atggacatggcacaggagccagttactttccgggatgtcgccatctacttttctcgcgaagagtgggcctgcctcgaaccgagccagagagccttgtatagagatgttatgttagataatttcagctccgtagccgcacttggcttttgtagcccgcgacccgatctcgtatcacgactggaacagtgggaggaaccatgggtggaagacagggaacgccctgagtttcaggccgtgcaaaggggaccaaggccaggggctcggaaatccgctgatcctaaaaggccatgtgaccaccccgcatgggcccacaaaaagactcacgtaagacgagaacgggcacgcgagggatcgagctttcgcaaaggctttaggttggataccgatgacggacaattaccacgggcagcccctgaacggactgatgctaagcccactgcgttcccttgtcaggttctgacccaaaggtgtggccgaagacccggaagacgggagcggcgaaaacaacgcgctgtggaactgtcgttcatctgtggcacgtgcggtaaagcacttagttgtcatagcaggctcctcgcacaccaaacggtccacactgggacaaaggcattcgagtgcccagagtgtggccagactttcagatgggcctccaatctgcagaggcatcagaagaatcacacgagagagaaacccttttgctgcgaggcatgcgggcaagcattcagcctgaaggatcgcctggcccagcatcggaaagtgcataccgaacatcgtccttacagctgtggggattgtggaaaagccttcaaacagaagtccaatctgctgagacaccagcttgtgcacactggagagcgtccattctattgcgctgactgtggaaaggcatttcgaactaaagaaaacctgagtcaccatcagagagttcacagtggggaaaagccctacacctgtgcagagtgtggcaagtcattccggtggcctaaaggcttcagcatccaccgtaggctccacctgaccaagcgcttctacgaatgtgggcactgcggaaaaggattccgacatctcggcttctttacccgacatcagcggactcatcgccacggtgaggtctag

SEQ ID NO: 25783 - DNA, 1116 bp, Artificial Sequence
  Description of Artificial Sequence: Synthetic coding sequence
atggacatggcccaagagccagtgacctttagagatgtcgctatatatttcagccgcgaagaatgggcttgcttggaacctagtcagcgggctctgtatcgcgacgtcatgctggataatttttcctccgtggcagcactgggcttttgtagtccgcgtcccgatctggtgtcacgactggaacagtgggaagaaccctgggtggaggaccgagagcggcctgaatttcaggcggtccaaagaggaccaagaccaggcgcaaggaaatcagcggatcctaagcgcccttgcgatcatcccgcatgggcacacaaaaaaacacacgtacggcgtgagagggccagggaagggtcttcttttcgcaaaggatttcggctcgacacagatgacggccagttacctagggccgcaccagagcgtacagacgctaaaccaaccgcgttcccctgccaggttcttactcagcgctgcgggagacgcccaggtcgcagagagaggagaaaacagcgagccgttgagctctccttcatctgcggaacctgtggcaaggccttaagctgtcacagcagattactcgcccaccagacggttcatactggaacaaaggcttttgagtgtcctgagtgcggtcagaccttccggtgggcgtcaaatctgcagcgccaccagaaaaatcacactagagagaaaccattctgctgcgaagcttgtggccaggcgttttcactcaaagaccgcctggctcagcacaggaaggttcacacagagcaccgaccatactcatgcggagactgtggaaaagcctttaaacagaaaagcaatctgttgcgacatcagctggttcacactggcgagagacccttttattgtgccgactgtgggaaggcgttccgcacaaaagaaaatctcagccaccaccagcgggttcatagcggagagaaaccctacacttgcgctgagtgcggcaaatcgtttcgctggccgaaaggcttctccattcaccgcaggttgcacttgacaaagagattctacgaatgtggacactgcgggaagggattcagacatcttggcttttttacaaggcatcagcgcactcaccggcacggcgaggtgtag

SEQ ID NO: 25784 - DNA, 144 bp, Artificial Sequence
  Description of Artificial Sequence: Synthetic coding sequence
atggacatggctcaagagcccgtcactttccgggacgtcgcaatctatttttccagagaggaatgggcttgcctggagccttctcagcgtgctctgtatcgcgacgtgatgttggataacttctccagcgtggctgccttgtag

SEQ ID NO: 25785 - DNA, 240 bp, Artificial Sequence
  Description of Artificial Sequence: Synthetic coding sequence
atggacatggcacaggaacccgtgacctttagggacgtcgcaatatatttctctcgagaggagtgggcctgcctcgaaccatctcaacgagccctgtacagagacgtgatgctggacaatttcagctcggtcgccgcactgggcttctgttcccctaggcccgacctggtttcccgcctggagcagtgggaggaaccatgggtggaggatcgcgagcgtccggaatttcaggccgtctag

SEQ ID NO: 25786 - DNA, 1116 bp, Artificial Sequence
  Description of Artificial Sequence: Synthetic coding sequence
atggacatggcccaggagcctgtcacatttagagatgtggccatctatttcagcagagaggagtgggcatgcctcgaaccgtcccagcgcgctctttacagggacgttatgctggataacttcagtagtgtagccgctcttggcttctgcagcccacgcccagatctcgtctcacggctggagcagtgggaggaaccttgggttgaagacagggagagacccgagttccaggccgtccagcggggtccccgacccggagcccgaaagtctgccgatcctaaaaggccatgcgatcacccagcttgggcgcataagaaaacacacgttaggagggaaagagctagggaaggaagtagtttccgtaaaggcttccgactcgataccgacgacggacagttgccacgtgccgctccggagcgtaccgatgccaaacccaccgccttcccatgccaagtcctgacacagcggtgcggaaggcgcccagggcgtcgtgaaaggagaaagcagcgagctgtggaattgtcttttatctgtggtacctgcgggaaggccctttcgtgccattcccgactcttggcccaccagacggtgcataccggtactaaagcattcgaatgtcctgagtgcggacagacctttcgctgggcttcaaatttacagaggcaccagaagaaccacaccagagagaaacctttttgctgtgaagcttgcggacaggccttctcgcttaaagacaggctcgcgcagcatagaaaagtgcacaccgaacataggccctactcctgtggagactgtggcaaagcctttaaacagaaaagtaacctgctcagacaccaattggtccacacaggagaacgccctttttattgcgcggattgcgggaaagccttcaggactaaagagaacctgagccatcatcagcgtgtccattcaggagagaagccttatacgtgtgccgaatgtggaaagtcgtttcgctggcccaaaggtttctcaatccaccgcagacttcacctcactaaacgcttttacgagtgcggccactgtgggaagggattccgacatctgggtttttttacacggcaccagcgaacacatcgccatggcgaggtatag

SEQ ID NO: 25787 - DNA, 1116 bp, Artificial Sequence
  Description of Artificial Sequence: Synthetic coding sequence
atggacatggcacaggaacctgtcactttccgggatgttgccatctacttcagcagggaggaatgggcttgtctggaaccatctcaacgggctctatatagagatgtcatgctcgataatttttcaagcgtagcagccctgggcttttgcagtcctcgcccagatctagtgagccgcttagagcagtgggaggagccatgggtggaagacagagagcgacccgagttccaggccgtgcagcggggacctcggccaggagcaaggaagtctgccgatcccaagcgaccctgtgatcaccctgcctgggctcacaaaaagacccatgtaaggagggaacgggcaagggagggctcttcgtttcgcaagggctttcggctggacacggatgatggccagcttcctcgggctgcacctgagcgcacagatgctaagcccaccgcctttccatgccaggtcttaacacagcgatgcggacggcgaccgggtagacgggagaggaggaagcaaagagcagtagagctgtccttcatctgtggcacctgtggcaaagccctttcgtgccacagccgattattagcccaccaaactgtccacacaggcacaaaagccttcgaatgccctgaatgcggtcagacattcagatgggcatccaatttgcagcggcaccagaaaaatcataccagggaaaaacccttctgctgcgaagcatgtgggcaggcctttagtctaaaggacaggctcgcccagcaccggaaagtgcacacggaacacaggccttactcttgcggggattgtggtaaagcgtttaagcagaagtcgaacttactgcgccaccaactcgtgcacacaggcgaacgcccattctactgtgcagactgtgggaaggcgtttcggactaaagagaatttatctcaccatcagagggtccactccggagaaaagccttatacttgtgctgaatgtgggaagtcctttcggtggccaaagggctttagcattcatcggaggttacatctgactaagcgcttctatgaatgcgggcactgcggcaagggcttcagacacctggggtttttcacccgacatcagaggacccacaggcatggggaggtttag

SEQ ID NO: 25788 - DNA, 426 bp, Artificial Sequence
  Description of Artificial Sequence: Synthetic coding sequence
atggatatggcgcaggagcccgtgacattcagggatgtagccatctacttcagtagagaagagtgggcctgtcttgaacccagccagcgcgctttgtatagggacgtcatgttagacaacttttcttctgtagctgctttgggcttctgttcccccagacccgatctggtaagtcgcctcgaacagtgggaggagccttgggttgaagaccgggaacggcctgagtttcaagccgttcaacggggaccaagaccaggggctcgcaagtctgcggaccctaagcgcccatgcgatcacccggcatgggcgcacaagaaaactcacgtgcgccgtgaacgggctagagagggttcctcatttcgcaaaggatttaggctggacacagatgacggccagctgccccgagccgctccggagagaacctag

SEQ ID NO: 25789 - DNA, 1692 bp, Artificial Sequence
  Description of Artificial Sequence: Synthetic coding sequence
atgggtccacttacattcatggatgtagctattgaatttagcctggaagagtggcaatgtctggacacagcacagcaaaacctgtatagaaatgtgatgcttgaaaattaccgcaacctagtatttctggggatagctgtctcgaatctagacttaatcacatgcttagagcagggcaaggaaccttggaacatgaaaagacatgagatggccgctaagccaccagccatgtgtagccattttgccaaagatttaaggccggagcagtacattaaaaattcattccaacaggtcattttgaggcgatatgggaaatgcggctaccaaaagggatgcaagagtgtagacgaacacaaactgcacaaaggcggacacaaagggttaaatcgctgtgtcaccactacccagtcgaaaatcgttcagtgcgacaagtacgttaaggtgttccacaaatacagcaatgcaaagcggcacaagatccgacatacgggaaaaaacccctttaaatgtaaagaatgcgggaagtccttttgcatgctgtcccaactcacccagcacgaaatcatccatactggcgagaagccatacaaatgcgaagagtgcggtaaggcctttaagaaaagttccaatctcaccaatcataaaattatccatactggcgaaaaaccttacaagtgcgaggaatgtggcaaggctttcaaccaatcatctaccctcacccggcacaagataattcacacaggagagaaactttataaatgtgaggagtgtggaaaggctttcaatcgaagcagcaatctgaccaagcacaaaattgtgcatacaggagaaaaaccttataagtgtgaggagtgtggcaaggccttcaagcagtctagcaatttgacaaaccacaagaaaattcataccggtgaaaaaccttacaaatgcggggaatgtggcaaagcttttaccttatcttcccatctgactactcacaagagaatccacacaggggaaaagccatacaagtgcgaggagtgcggcaaagctttttccgtcttctcaaccctgaccaaacacaagatcatccacacagaggaaaagccttacaagtgtgaagaatgtggcaaagctttcaataggtccagccatcttaccaaccataaggtgatacacactggggagaagccatacaagtgcgaagagtgcggtaaagcatttactaaaagctccacgcttacctaccacaaagtgattcacactggcaaaaagccttataagtgtgaagagtgcggcaaagcttttagcatattctcaatcctgactaaacataaggtcattcacactgaggataaaccttataagtgtgaagagtgtggaaagaccttcaattactcaagtaatttcacgaatcacaaaaaaattcataccggcgaaaagccctacaagtgtgaggagtgcgggaagtccttcatcctctcctcccatctgacaacacataaaatcatccacactggggaaaaaccatacaaatgtaaggaatgtggcaaagcattcaatcagtcctcgacccttatgaaacacaaaataattcacaccggggagaaaccgtataagtgcgaggagtgcggtaaagccttcaatcagtcacctaatctcacaaagcacaagaggatccataccaaagagaagccctacaagtgtaagtag

SEQ ID NO: 25790 - DNA, 1926 bp, Artificial Sequence
  Description of Artificial Sequence: Synthetic coding sequence
atggactctgtggtctttgaggatgtggctgtcaatttcactcaggaggaatgggcactgctgggcccttctcaaaaaaagctgtacagagatgttatgcaggaaacgtttgtcaacctggctagcatcggcgagaattgggaggagaaaaatatcgaggatcataaaaaccaaggaaggaagctgaggtcccacatggtcgagagactctgtgagcggaaggaggggtcacagtttggagaaacaatctcacagactcccaatcctaaacctaataagaagactttcaccagagtcaaaccatacgagtgctccgtgtgcgggaaggactacatgtgccactcctctcttaatagacatatgcgctcccacactgagcatagaagctacgaataccacaaatatggtgagaaaagttatgaatgcaaagagtgcggaaaaaggttttctttcaggtcaagttttcggattcatgagcgcactcacacaggcgaaaaaccttacaagtgcaagcagtgtggaaaggccttcagctggccctcatcatttcagattcatgaaaggacccatactggggagaagccttacgagtgcaaagagtgcggaaaggcattcatatatcacaccacgttccgcggacatatgaggatgcacacaggtgagaagccatataagtgcaaagaatgtggaaaaacctttagccacccttcgagtttccggaaccacgagcgcacccattctggggagaaaccatatgaatgcaagcaatgcggtaaggcattccggtactaccaaaccttccaaatccatgaacgcacacacaccggagagaaaccctatcagtgtaaacagtgtgggaaagctctttcatgccctacttcttttcgcagccacgagcgcattcacactggcgaaaagccctacaaatgtaaaaaatgcgggaaagcatttagtttcccatcctccttccggaagcatgagcgcatccacaccggcgaaaagccctacgattgcaaggaatgcggtaaggcctttatctccctgccatcatacagacgacatatgataatgcatacgggcaatgggccttacaaatgcaaggaatgcggcaaggcattcgactgcccatcatcctttcagatccatgaacggactcatacaggggaaaagccttacgagtgtaaacagtgtggtaaagcctttagctgcagttcttcattccgcatgcacgagaggactcacaccggcgagaagcctcacgaatgtaaacagtgcggcaaggcttttagctgctcctcatccgtgaggatccacgaacggacacacacaggggagaaaccatacgagtgtaagcagtgtggcaaggcattcagctgctcctcaagctttcggatgcatgagcgaatccatacgggggaaaaaccatatgaatgtaagcagtgcggtaaagcgttctccttttcttccagttttcgtatgcatgaacgaacacacaccggtgagaaaccatatgagtgtaagcagtgtggcaaagccttctcatgctccagctcatttcggatgcacgagaggacccacaccggagagaaaccatacgagtgtaaacagtgtggtaaagccttttcctgttcctcctcaatacggattcacgagcgaacgcacaccggtgagaaaccatacgaatgcaagcagtgtggaaaggcgttcagctgttcaagctctgtccggatgcatgagaggacacacaccggagtcaagccctatgagtgcaagcaatgcgacaaggcgttttcctgttctaggtccttcagaatccacgagagaacccataccggggagaagccctacgcctgtcaacagtgtggaaaggcctttaaatgcagtaggagttttagaattcacgaaagagttcactcaggcgaatag

SEQ ID NO: 25791 - DNA, 1926 bp, Artificial Sequence
  Description of Artificial Sequence: Synthetic coding sequence
atggatagtgtggtattcgaggatgttgcagtgaattttacccaggaggagtgggccttactcgggccttcacaaaagaaactctaccgggatgttatgcaggagactttcgtcaatctggcttctattggtgaaaattgggaggagaagaatatcgaggatcataaaaatcaggggaggaaactgaggagccacatggtcgaacgtctgtgcgagcgcaaagaaggttctcagtttggtgaaaccatttcacagacgccaaatcctaagcccaacaagaagacctttacaagagtgaaaccatatgaatgttctgtgtgcgggaaggattacatgtgccacagctccttgaaccgtcacatgagaagccacacagagcacagaagctacgaataccacaagtatggggagaagtcttacgagtgcaaggaatgtggaaaaagatttagctttaggagctcattccggatccacgagcgcacccataccggcgagaagccatacaagtgcaagcagtgcggcaaggcttttagctggccctcaagcttccagatacatgagcgcacccataccggtgagaagccctatgaatgtaaggaatgcggaaaggcatttatttaccacaccactttccggggacacatgcggatgcacaccggggagaaaccttataagtgtaaggagtgcggtaagacctttagccaccctagttccttccgcaatcatgaacggacccacagcggggaaaagccttacgaatgcaaacagtgcggcaaggctttccgatattaccagacatttcaaatccacgagagaacccatacaggggaaaagccttatcagtgtaagcaatgtgggaaagccctaagctgtcccacctcattcaggagccacgaacggatccatacaggtgagaagccttacaagtgtaagaagtgcggtaaggctttcagcttccccagctcctttcgcaagcacgaacggatccatacgggcgagaagccatatgactgcaaagaatgtggcaaagcctttattagccttccatcttaccggcgacatatgatcatgcacactggaaatggaccatacaagtgcaaggagtgcggaaaggcctttgattgcccctccagctttcagattcacgagaggacccacactggtgaaaagccctatgagtgtaagcagtgcggcaaagcattctcctgtagttccagcttccggatgcacgaacgcacacacaccggggaaaagccccacgagtgcaagcagtgcggcaaggcttttagctgttcatcctctgttcgcatacatgagaggacacataccggggagaaaccctatgaatgcaaacaatgtgggaaagcctttagttgttcgtccagctttcgcatgcatgagcgcatccacacaggggaaaaaccgtacgagtgtaaacagtgcgggaaggccttcagtttttcaagtagcttcaggatgcacgagaggacccacaccggagagaaaccgtatgagtgtaagcagtgtgggaaagcctttagctgctcgtcgtccttcaggatgcacgagcgcacacatactggcgaaaagccatacgagtgtaagcagtgcggaaaagcattttcctgtagtagttctatccgcattcatgagaggacccataccggcgaaaaaccctatgagtgcaagcagtgcggcaaggccttttcctgtagctcatcggtgaggatgcacgagaggacgcatacaggcgtgaagccatatgagtgtaaacaatgtgacaaggcattctcgtgcagtcgctcatttcggatccacgagaggacccacactggggagaaaccctatgcttgccaacagtgtggtaaagccttcaagtgctcaaggtcctttcggatccatgaacgagtccatagtggcgaatag

SEQ ID NO: 25792 - DNA, 1995 bp, Artificial Sequence
  Description of Artificial Sequence: Synthetic coding sequence
atggaaggttttatggattccgggactcagacggatgccgtggtcgtgctaagcctggctcaggcagcagtactgggactggtaagtgaaaacgagctcttcggggcaaccatttccgctgaggccttctatcccgatttgggccctgagttgagcggggcagcaatgggagagcccgagcccccagggcctgacgtttatcaactcgcatgcaatgggcgagccctggaggaacctgcagaagaggaggtgctggaggtcgaagctgcatgcgagaaacacaccaggcggaaaacccgaccaccagtgcgtctggtccccaaggtcaaattcgagaaggtcgaggaggaagagcaagaggtgtatgaggttagcgttccgggagatgataaggatgcgggtccagctgaagctccagcggaggccgcttccggaggctgcgatgccctggtgcagtcttccgctgttaagatgatagatctctccgccttttccagaaagcctaggacccttaggcaccttccgaggacgccacgccctgagttaaatgtggctccctacgatccacatttccctgctcccgctagggacggcttccccgagccaagtatggcattgccaggcccagaggccctgccaactgagtgtgggtttgaacctccacatctggctcccctctcagaccccgaggcgccttctatggaatcccctgagccagttaagccagaacagggctttgtctggcaagaggcatcagagtttgaggccgacaccgcaggctctaccgtagagagacataaaaaagctcaactggatcgcctcgacatcaacgttcagattgatgattcatatctggtcgaggcgggtgaccggcagaagagatggcaatgcagaatgtgtgagaagtcatatacaagcaagtataacctggtgactcatatcctgggacacaacggcatcaagccccatagttgcccccattgctctaagctgttcaaacagccgtctcacctccaaacacatcttctcacacatcagggcacgagaccacataagtgccaggtttgtcacaaagcctttactcaaaccagccacctgaaaagacacatgttattgcactccgaagtgaaaccctactcatgccacttctgtggcagaggcttcgcttaccctagcgagttaaaagcacacgaggtgaagcatgagtccggcaggtgtcatgtgtgtgtagagtgcggacttgacttttctactctgacgcagttgaaacgtcacctggctagccatcaagggcctactctttaccagtgtttggaatgtgacaaaagcttccactaccgttctcagctgcagaaccatatgttaaaacatcagaatgtaaggccttttgtctgtactgaatgtggcatggaattcagccagatccaccatctgaaacagcactctttgacacacaagggggtaaaagaatttaaatgtgaggtttgtgggagagagttcactctgcaagccaacatgaagcggcatatgctcattcacacaagcgttaggccttatcaatgtcatatatgtttcaagactttcgtgcagaaacagaccctgaagacgcacatgattgtccacagtccggtgaagccctttaaatgcaaagtgtgcggaaaaagtttcaatcgtatgtataacttgcttggtcacatgcacctgcatgccggtagtaaaccctttaaatgtccatattgtagcagcaagttcaatctgaaaggcaatctgtctcggcacatgaaggtcaaacatggagtgatggacatcggattagatagtcaggatcctatgatggaactaacaggcaccgacccatcagaactcgatggacagcaggagatggaagactttgaggaaaacgcatactcctacgcgagcgtcgacagctccgccgaggcctctgtgcttacggagcaggcaatgaaagagatggcctactataatgtcctatag

SEQ ID NO: 25793 - DNA, 240 bp, Artificial Sequence
  Description of Artificial Sequence: Synthetic coding sequence
atggaggggttcatggacagcggcacccagacagacgctgtggttgttttgagcttagcacaggctgccgtcctgggcctggtttcggaaaacgagctttttggtgccaccatttctgccgaagctttctaccccgacctgggccctgagctctcaggagctgccatgggggaacccgagccccctggccctgacgtttatcagctggcttgtaacggcagagccctggaagaaccatag

SEQ ID NO: 25794 - DNA, 1293 bp, Artificial Sequence
  Description of Artificial Sequence: Synthetic coding sequence
atggaagaggaggaaatgaatgatggctctcagatggtaagaagtcaggaatctctgaccttccaggacgtcgcggttgactttacccgcgaagaatgggaccagctctaccctgctcagaagaatctgtacagggacgtcatgctcgagaactaccggaatcttgtggctctagggtaccagctatgtaaacccgaagtgatagcacagttagagctcgaggaggagtgggtgatcgaaagagactccttgcttgacactcatcccgatggcgagaaccggccagagatcaagaaaagtacaacgtcacaaaacatcagcgatgaaaaccagacacacgaaatgatcatggagagactcgcgggagattccttttggtacagtattctgggagggttatgggattttgactaccatccagagtttaatcaggaaaatcacaaacggtacctcgggcaagtgacactgacccacaaaaagatcacacaggaaaggtctcttgagtgtaataagttcgccgaaaactgcaacctgaactcaaacctgatgcaacagcggataccatcaatcaagatcccgctgaattcggacactcagggtaactctattaagcacaactccgaccttatttactaccaggggaactacgtaagggaaactccgtacgagtatagcgagtgtgggaaaatctttaaccagcacatcttgctcaccgatcatatccataccgccgagaagccaagtgaatgcggcaaagctttctcccacacatcgtcactgtcacagcctcagatgttactgacgggagaaaagccttacaagtgtgacgaatgcggaaaaagattttcacagaggattcacttgatccaacaccaacgaattcacaccggcgagaagccattcatctgcaatggttgtgggaaagcattccggcagcacagtagtttcactcagcacttgagaattcacaccggagagaagccttataagtgcaatcaatgcgggaaggcctttagccgcatcacttccctcacggagcaccacagactgcacaccggagaaaagccttacgaatgtggcttttgtggaaaagccttttcccagcgtacacatctcaaccaacatgagaggacacatactggggagaaaccttataaatgtaatgaatgtgggaaagcattctcccagtctgcccacttgaatcagcaccgcaagatacacactagggaaaagctgtgtgagtataagtgcgagcaaacagtccggcactcacccagtttttcatcaacatag

SEQ ID NO: 25795 - DNA, 2736 bp, Artificial Sequence
  Description of Artificial Sequence: Synthetic coding sequence
atgtgctctcatttcacacaggatttcttgccggtgcaaggcatcgaagactctttccacaaactcattctgagacgctacgagaaatgtgggcatgacaatctgcagctaagaaagggttgcaagtccatgaacgtgtgtaaggtccagaaaggtgtctacaatggcatcaacaaatgcctttctaacactcagagtaagatttttcagtgtaacgccagggtgaaggtcttctccaagtttgcaaattcgaacaaagacaagacccgacacacgggcgagaagcatttcaaatgtaacgagtgtggtaagagttttcagaaatttagtgatctcactcagcacaaaggcatccatgcgggagaaaaaccgtacacttgtgaagagcgaggcaaggactttggatggtatactgaccttaatcagcacaaaaagattcacaccggtgagaagccatacaaatgtgaggagtgcggcaaagcatttaacagatcaacaaacttgacagctcataagagaatacacaatcgggagaaagcgtacactggcgaggatcgggacagggcgttcggatggagtaccaatttaaacgagtacaagaagatccatactggagataagccctacaagtgtaaagaatgtgggaaggccttcatgcactcaagccacctgaacaaacacgaaaagattcacaccggcgaaaaaccttataagtgtaaggaatgtggaaaggtcatatctagcagctcttcattcgccaagcataaacgcattcatacgggagaaaaaccatttaagtgtttggagtgcggcaaggcctttaacatctctactacccttacaaagcatcgcagaatacatactggggagaaaccttacacctgcgaagtgtgcgggaaggccttccgacagagcgccaacctctacgtgcatagacgaattcacacaggagagaagccctatacctgtggggagtgtgggaaaacttttcgccagtctgctaacttatacgttcacaggcgcatacacacgggtgaaaaaccctacaagtgtgaagactgtggcaaagcctttgggcgatacaccgccctgaatcaacacaaaaagattcacactggcgagaagccttataaatgtgaagagtgtggtaaggccttcaacagttctacaaatctaaccgctcacaaacgtattcacacacgagagaagccctacacctgtgaggatcgcggtcgcgcattcggactgagtaccaacctaaatgaatacaagaagattcatacaggggataagccttacaaatgtaaagagtgtggaaaagccttcatacactcacttcacctcaacaaacatgagaagattcataccgggaagaaaccttataaatgcaaacaatgtgggaaagttattacttcatctagcagttttgccaaacataagagaattcatactggagaaaagcctttcgaatgtctggagtgcggaaaggcatttaccagttcaaccacactcacaaaacaccgacgcatacacacaggcgaaaagccttacacctgcgaggtttgtggtaaggccttcagacagtcagccattctgtatgtgcaccgcaggattcataccggcgagaagccgtacacatgtgaggaatgtggtaaaaccttccgccaatctgctaatttatacgtgcatcggagaattcataccggagagaagccttataagtgtgaggagtgcgggaaggcttttggacgctatactgacttaaaccaacacaagaagattcataccggtgaaaaactgtacaagtgtgaggagtgtggtaaggatttcgtgtggtacaccgaccttaaccaacagaagaagatttataccggcgagaagccctacaagtgtgaggagtgcggaaaagccttcgccccaagcaccgacttgaatcagcacacgaaaatcctcactggagagcagagttataaatgcgaggagtgcggcaaggcctttgggtggagcattgctctcaaccagcacaagaaaattcacaccggcgaaaaaccttataagtgcgaggagtgtggaaaggcattttcacggtcccggaaccttacgacacaccgcagggtccacacgagagaaaagccatacaagtgtgaagaccgcggacgcagttttgggtggagcacaaacctcaacgaatacaagaaaatccatacaggggacaaattgtataaatgcaaagagtgcggcaaagttttcaaacagagctcacatctaaatcgccacgagaaaatccacacgggcaagaagccgtataaatgtaaagagtgcggtaaggtgatcacttctagcagcagctttgccaagcacaaacgaattcatactggtgaaaaaccttttaaatgtctcgagtgcgggaaagcgttcacatcttccaccactttgaccaagcacaggcgcattcatactggggagaagccatatacatgtgaagagtgtggcaaagccttcagacagagcgcaatactttatgtgcatcgacggatccacaccggagagaaaccatacacgtgtggcgaatgcggcaagactttccggcagtctgctaatttatacgcacacaagaaaatccacacgggcgagaaaccttacacctgtggggattgcggcaagaccttccgacaatcagccaatctttacgcacacaagaagattcacaccggggataagacaatacaggtctag

SEQ ID NO: 25796 - DNA, 399 bp, Artificial Sequence
  Description of Artificial Sequence: Synthetic coding sequence
atggagccccttacattcagggacgtggccattgaattcagccctgaggaatggaagtgcttggatccagcccagcagaacctctacagagacgtaatgctggaaaactatcgtaatctggtgtccttagctatgtgctcccattttacgcaagattttctgcctgttcagggcattgaggattccttccacaaactgatccttaggcggtacgaaaaattctcctccctgattagttcatgcagagtaatctcccatgggttatctcgaggcagaaatcgagccacagagaagaatgatcttctcaccacagaggagccagttgtgaagcatagattcgatctgcagtacccggaggaaatgtggaggaacaccgtcgtgcagaaggggagaaaatag

SEQ ID NO: 25797 - DNA, 2772 bp, Artificial Sequence
  Description of Artificial Sequence: Synthetic coding sequence
atgctggaaaactaccggaaccttgtgtcgctggccatgtgttcccattttactcaagatttcctccccgttcaaggaattgaggactcttttcataaactcatactgaggagatacgagaagtgcggtcatgacaatttgcaacttcgcaagggttgtaagtctatgaacgtgtgcaaggtgcagaagggagtctataatgggattaacaaatgtctcagtaatacccagtcaaagatctttcaatgtaacgcgcgtgttaaagttttcagcaaattcgccaattccaataaagacaagacacggcacacgggcgaaaagcattttaagtgtaacgaatgtgggaaatctttccagaaattcagcgacctcacacagcataaggggattcatgccggagagaaaccctatacctgtgaagaacgtggaaaagattttggctggtataccgacctgaatcagcataagaaaatccatacaggcgaaaagccgtacaagtgcgaagaatgcggtaaggccttcaatcgctccacaaacctcaccgcccataaaaggatacacaatagagagaaggcctacaccggagaagacagagatcgtgccttcggatggtcaacaaacctgaatgagtataaaaagattcatacaggcgacaaaccgtacaaatgcaaggagtgcggaaaagccttcatgcatagcagccacctaaacaagcacgaaaagatccacaccggagagaaaccctataagtgtaaggaatgcggcaaagttatttcttccagttcatccttcgctaaacacaagcgcatccacacaggcgaaaagcctttcaagtgtcttgagtgcggcaaggcttttaatattagtacaacgctaactaaacatcgacgtatacacaccggggaaaagccttatacatgtgaagtgtgcgggaaggcatttcggcagagtgctaacctgtatgtgcaccgcagaatccacaccggcgaaaagccttacacctgcggagagtgcgggaagaccttcagacagtccgctaatctctatgtgcatcgcaggatccataccggcgaaaagccatacaagtgtgaagactgcgggaaagcattcggtagatacacagccctcaatcagcataaaaagatccacacaggcgagaagccctataagtgtgaggagtgtgggaaggcatttaattctagcactaatttaaccgcacacaagaggattcatactagggagaaaccgtatacctgcgaagaccggggaagagcctttgggctctctacaaacttgaatgagtataagaagatacacaccggggacaaaccctacaagtgcaaggaatgtggcaaggcttttatccactcactccacctgaataagcacgagaaaattcatacaggaaagaagccctacaagtgcaagcaatgtggcaaggtgataacaagcagctcctcattcgcaaagcacaagagaatccatacaggagagaagcctttcgaatgcctggagtgtggcaaagcttttactagcagtaccacattgacgaaacaccgcagaatccacactggtgagaagccatacacatgtgaggtgtgcggcaaggctttccgacaatccgccatactttacgtgcacagacggattcacacaggtgagaaaccttatacatgtgaagagtgcgggaaaaccttccgtcagtccgcaaatctctacgtgcacagacggattcacactggagaaaagccctacaaatgtgaggaatgcggaaaggccttcggccgatacactgatctgaaccagcataagaagatacacacaggggagaagctgtacaaatgtgaggaatgcggtaaagactttgtgtggtacacagaccttaaccagcagaagaagatatataccggggaaaagccttataagtgcgaggagtgcggcaaggcgttcgcgccttccacagatctgaaccagcacactaaaatactcacaggcgaacagtcttacaagtgtgaagagtgcggcaaggccttcggctggtctatagcactgaaccagcacaaaaaaatacacaccggagagaaaccttacaagtgtgaagagtgtggcaaagccttctctaggagccggaacctcacgactcaccgtcgggttcatactcgtgaaaagccatacaaatgcgaagaccggggtcgctcattcggatggtcaacgaacctgaatgagtacaagaagatccacactggagataaattgtacaaatgcaaagaatgcgggaaagtcttcaagcaaagcagccatctgaacaggcatgagaaaattcataccgggaagaagccatacaaatgtaaagaatgtgggaaagtgatcacctcaagtagttcctttgcaaaacacaagcggatccacaccggggaaaagccatttaagtgcctggagtgtggtaaagcattcacctcttctaccacactgacgaagcaccggcgaattcacactggcgagaaaccctacacgtgcgaggagtgcggaaaagccttccgacagtccgcaatcctatacgttcatcgcaggattcatacgggtgaaaagccctacacctgcggagagtgcggcaagactttccggcagagcgctaacttgtatgctcataagaaaatccacacaggagagaagccatatacgtgcggcgactgcgggaaaacattccggcagtcagctaacctgtatgctcacaagaaaattcacactggcgataagaccattcaggtttag

SEQ ID NO: 25798 - DNA, 2217 bp, Artificial Sequence
  Description of Artificial Sequence: Synthetic coding sequence
atggggctgctgaccttcagggacgtggctatcgagtttagtctggaggaatggcaatgtctggacaccgcccagaaaaacctctacagaaatgtgatgcttgaaaactacaggaacttggcatttctgggcatcgctgtgagtaaaccagacttgattatatgcctggagaaggagaaggagccctggaatatgaaaagggacgagatggtggacgagcctccaggcatttgtccccactttgcgcaggacatttggccagaacagggggtcgaggattctttccagaaggtgattctgaggcgtttcgaaaagtgcggccatgagaacctgcagctccggaaggggtgtaaatccgtcgatgaatgcaaggtgcacaaagaaggttataatggcctcaaccaatgcttcactacaacacagggaaaggctagtcagtgtggcaaatacttgaaggtcttttataaattcataaatctgaatagatataaaattcgccataccaggaagaagccgtttaaatgtaagaactgtgttaaaagcttctgtatgtttagccacaagacccagcataagagcatttacaccactgagaaatcttataaatgcaaggagtgtggcaaaaccttcaattggtcctctaccctcactaaccacaagaagacacacaccgaagaaaaaccttataaatgcgaagagtacggaaaggcctttaaccaatcaagcaactatacaactcataaggtgacccacactggcgagaaaccctataaatgcgaagaatgcggaaaggccttctcacagagttctacccttacaatccacaagaggattcatacaggtgagaagccctgcaaatgcgaagaatgtggcaaggccttttcacagccaagtgccctgaccatacacaagcgtatgcatatcggtgagaaaccttacaagtgcgaggaatgtggcaaggccttcgtatggtcctccacactgaccagacacaagcggctgcactctggcgagaaaccttataagtgtgaggaatgcgctaaagctttttcccagttcggccacctgacaactcataggataattcacaccggtgagaagccctacaaatgcgaagaatgtgggaaggcgttcatatggccctctaccttgacaaagcacaaaagaattcatacaggggagaaaccatacaaatgcgaggaatgtgggaaagcttttcatagaagttcaaatctgacgaagcacaaaatcattcatacaggggaaaagccatataaatgtgaggaatgcggaaaggccttcatatggagttctaaccttacagagcacaagaaaattcacactcgcgagaaaccatataaatgtgaagagtgttcgaaggcattttctaggagctctgccctgactacgcataagcgcatgcacacaggcgagaagccgtacaagtgtgaagaatgtggaaaagctttctcacagtcttcaacactcactgctcacaaaatcattcacactggggagaaaccatataaatgtgaggaatgtgggaaggccttcattctgagctctaccctgagcaagcataaaagaatccacactggcgagaagccatataaatgtgaagaatgtgggaagactttcaatcagagctctaaccttagcacccataagattattcatactggggagaagccatataaatgcgaagaatgtgggaaagccttcaatcgatcttcaaatctaagtactcacaagatcatccatactggagagaagccctataagtgtgatgagtgcggcaagtcattcatatggagttctacactgttcaaacacaagatcatccatacaggcgaaaagccttacaaatgtgaggagtgtgggaaggcgttcaatcactcccaaattctattgcacattcgccataaaaggatgcacaccggggaaaagccatacaagtgcgaagaatgcgggaaaagcttcaatctaagctcgacttttataaaacataaggttatccatacaggcgtgaagctgtataagtgtgaggaatgtggcaaagtgtttttctggtcaagcgccctcacaaggcataagaagattcatgccggacaacagccttacaaatgggaaaagattggtaaagcttttaaccagtcatcccacttaactactgacaagattacgcacataggcgagaaaagctataagtgcgagtag

SEQ ID NO: 25799 - DNA, 327 bp, Artificial Sequence
  Description of Artificial Sequence: Synthetic coding sequence
atgggcctcctgacttttagagacgtcgccatcgagttctctctcgaggagtggcagtgcttggatacggcacaaaaaaatctctatcgtaacgtgatgcttgaaaattatcggaacctggcattcctgggaatcgctgttagcaagcccgatctcataatttgccttgaaaaggagaaggagccctggaatatgaaacgtgatgaaatggtggatgagccgccaggcctcgctgtctccaatcctgatctgatctcttgtctagaacagattaaggagccttggaacgttaaacgccacgagacagttgtgaagtactcgggatag

SEQ ID NO: 25800 - DNA, 270 bp, Artificial Sequence
  Description of Artificial Sequence: Synthetic coding sequence
atggggctccttacttttagggatgtggcaatcgagttctccctggaggagtggcagtgcctcgacactgcccagaaaaatctgtatagaaatgtgatgcttgagaattataggaacctcgccttcctggggatcgctgtgtcaaaaccagacctgataatctgcctagaaaaggagaaagagccatggaacatgaagcgggacgaaatggtagacgaacctccggatggtgtgagcctctgccaccccggatggagtgccgtcgcttag

SEQ ID NO: 25801 - DNA, 234 bp, Artificial Sequence
  Description of Artificial Sequence: Synthetic coding sequence
atgggattgctcaccttccgcgatgttgctatcgaattcagcctcgaagagtggcagtgcctcgacactgcccagaaaaatctgtatagaaacgtaatgctggaaaactacagaaaccttgcatttctgggcatcgctgtctccaagcccgacttgatcatttgcctggagaaggaaaaagagccgtggaacatgaagagggatgagatggtcgatgagcccccaggaaggtag

SEQ ID NO: 25802 - DNA, 1851 bp, Artificial Sequence
  Description of Artificial Sequence: Synthetic coding sequence
atgggcctactaacgtttcgcgatgtagctatagagttttcgctggaagagtggcagtgtctggacactgcacagaagaacctgtaccggaacgtaatgctggagaattaccgtaatttagccttcttaggaatagctgttagcaaacccgatctgattatatgtctggagaaggaaaaagaaccctggaacatgaagcgagatgagatggtagatgagccacccggaatttgtccgcatttcgctcaagatatctggcctgagcagggggttgaagacagctttcagaaagtgattctgcgcaggtttgagaagtgcgggcacgagaacctccagctacgcaagggttgtaagagtgtcgacgagtgtaaagtgcataaagaaggctacaacgggttgaatcagtgctttactaccacccaaggtaaggccagtcagtgtgggaagtatctgaaagtgttttacaagttcataaatctgaaccgatacaaaattaggcacacacgcaaaaagccctttaaatgtaaaaactgcgtgaagtcattttgtatgttcagccacaaaacacagcataagagtatctacaccactgagaaatcctacaagtgtaaagaatgcgggaaaacctttaactggtcatccaccctcaccaatcacaaaaaaacccacactgaggaaaagccctacaagtgcgaggaatatgggaaggcattcaaccagtcctccaactacactacccataaagtcacccatactggagagaagccctacaaatgtgaagagtgcgggaaggcctttagccagtcttccacattgacgatccacaaacgcatccacacaggcgagaagccttgtaagtgcgaagaatgcgggaaggccttcagccagccatcggcgcttaccattcacaaacgaatgcatattggggagaagccatataaatgcgaagaatgtggaaaagcctttgtgtggtcttcaactctgacccggcacaagcgcctgcactcgggcgaaaagccgtacaaatgtgaggagtgtgctaaggccttttctcagttcgggcaccttactactcacagaataatccatacaggggaaaagccatataagtgtgaggaatgtggtaaggcttttatctggccgtccacactgactaagcacaaacgcatccatactggggaaaaaccctataaatgcgaggagtgcggcaaggcgtttcaccgaagttcaaatctcaccaagcacaagataatacatacaggggagaaaccgtacaaatgtgaagaatgcggcaaagcctttatctggagctccaacctgaccgagcacaagaaaattcacaccagagagaagccatacaaatgcgaggaatgcagcaaagcctttagccgaagttcggccctcaccacacacaaaagaatgcacactggcgagaaaccctataaatgtgaagagtgtgggaaggccttttctcagtcctcaaccttgacagcacataagattatccacactggtgagaagccctacaagtgtgaggaatgtgggaaagcatttatcctttcctctactctgagtaagcacaaaagaatccacaccggtgagaagccatacaaatgcgaagaatgtgggaagacttttaaccaatcatccaacctatccacacacaagattattcatacaggcgagaagccgtacaagtgtgaggagtgcggaaaggcttttaaccgatcttctaatttgagcacgcacaagattattcatacaggggaaaaaccgtacaagtgtgatgagtgtggtaaatccttcatctggtcctccactctatttaaacacaagagaatccatacttag

SEQ ID NO: 25803 - DNA, 3759 bp, Artificial Sequence
  Description of Artificial Sequence: Synthetic coding sequence
atgcccggagcccctggatccctggagatggggccactaacctttcgcgacgtgactatcgaattttcactggaagagtggcagtgtctagacaccgtgcagcagaatttgtatagagatgtaatgctggaaaactatcggaatctcgtattcttgggcatggcggtgttcaaacccgatctgatcacttgccttaaacagggcaaggaaccctggaatatgaagcgccacgagatggtaacaaagccccctgtgatgagaagtcactttacgcaggatctttggcctgatcagtctacgaaggactcatttcaggaggtgattcttaggacctatgcaagatgcggccacaagaacctccgcctcaggaaagactgtaaaagtgccaacgagggcaaaatgcacaaggagggatacaataaactcaatcagtgccggacagccacacagaggaagatcttccagtgtaacaagcacatgaaagtgttccacaagtactccaaccgcaataaggtgagacacactaaaaagaagacattcaagtgtataaaatgtagcaaatcattttttatgctcagttgcttaattcggcacaaaagaatccatatcagacagaacatctacaagtgcgaagagaggggcaaagctttcaagagtttctccactcttactaaacataagatcattcacaccgaagacaagccttacaaatacaaaaagtgtggcaacgcgttcaagtttagtagcacctttaccaaacacaaacggattcatacgggtgagaccccgtttcggtgcgaagagtgcggcaaagccttcaatcagtcgagcaacttaacggaccacaaaagaatccacaccggcgaaaaaacttacaagtgcgaagaatgcgggaaagcctttaagggaagcagtaatttcaatgcacacaaagtgatacacaccgcagagaaaccatataagtgtgaggactgtgggaagactttcaatcactttagcgccttgcggaagcacaagattatacataccggaaagaagccatacaagagggaggaatgcggtaaagccttctcgcagtccagcactttgcggaagcatgagatcatccatactggcgaaaagccttacaagtgcgaagaatgcggcaaagcattcaaatggtcgagcaagctaacggtccacaaagtggtgcacactggagaaaaaccgtacaagtgtgaggagtgtggcaaggcttttagccagttctctacgcttaaaaaacataaaattatacacaccgggaagaaaccatataaatgtgaggaatgcggaaaagcttttaactctagctccaccctgatgaagcacaagatcatacacaccggcgagaagccgtataaatgcgaagagtgcgggaaggcttttcgccagtccagccacttaacccgccacaaagctatacacaccggcgaaaagccttacaaatgcgaggaatgtgggaaagcttttaaccacttctccgacctaagaagacacaaaataatccatactggcaaaaaaccatacaaatgtgaagaatgcggaaaagctttctcccaatcaagcaccctgaggaatcatcagattatacatacaggagaaaagccttacaaatgtgaggaatgtgggaaagcattcaaatggagttcaaagctcacagtgcataaggtaatacatacgggcgagaaaccatgcaagtgcgaggagtgcgggaaagcttttaaacacttcagtgcactccggaagcacaaggtgattcacaccagggaaaagctgtataaatgcgaggagtgcggaaaagcttttaataacagctctattttggcgaagcacaaaattatccatactggcaagaaaccctataagtgtgaggagtgtggcaaggcctttcgacagtcctcacatcttacccggcacaaagcaatacatactggcgagaaaccgtacaagtgcgaggaatgcggaaaagcattttcccatttctccgccctgcggagacacaaaatcatccacaccggcaagaaaccctacaaatgcgaagaatgcggtaaggcatttagtcactttagcgccttaaggagacacaagataatccatacgggggaaaaaccttacaaatgcgaagagtgtggaaaggccttcaagtggtctagcaaattaactgtccataaagttattcacaccgccgaaaagccatgtaagtgcgaggagtgtggcaaatcatttaagcacttctctgctttgagaaagcataaggtgatccacacacgcgagaagctttacaagtgtgaggagtgcgtgaaagctttcaattccttttccgccctcatgaagcacaaagtgatacatacgggtgaaaaaccctacaagtgcgaggaatgcggcaaggcatttaagtggtcatccaagctgaccgttcataaggtgatccacactggggagaaaccctgtaaatgcgaggagtgtgggaaggccttcaagcatttctcggccttaagaaaacacaaagttatacatacgggaaagaaaccttataaatgtgaagagtgtgggaaggccttctctcaaagctcttccctgcggaagcacgagatcatccattcaggtgaaaaaccttacaaatgtgaagaatgcggcaaggcttttaaatggctctctaaactcaccgtccacaaggtgattcatacagctgagaaaccctgtaagtgtgaggaatgtgggaaggcctttaagcacttttcggctctgcgcaagcataagattatccatacagggaagaagccttataagtgtgaagaatgtggcaaggcgttcaatgattcttccacactaatgaagcacaagattatccacaccggtaaaaaaccatacaagtgcgccgaatgcggcaaagctttcaagcagtcttctcatcttacccgccacaaggctatccatacgggtgagaagccatacaagtgcgaagagtgcggcaaagactttaacaactctagcaccctgaaaaaacacaaactaatccacactagagaaaaactgtataagtgcgaggagtgtgtaaaagcttttaataacttcagcgctctgatgaaacacaagattattcatacaggggagaagccttacaaatgcgaagaatgcggaaaagcatttaaatggtcatccaagctgacggagcacaaggtaattcatactggagagaaaccatgcaaatgcgaggagtgcgacaaagcttttaagcattttagcgctctgcggaagcacaaggtcatccatacgggtaagaagccatatcagtgcgacgaatgcggcaaagcgttcaacaatagctcaaccctcacaaagcacaaaatcattcacacaggggaaaaaccgtacaaatgcgaggagtgcggcaaggccttctcccagagtagtatactgacgaaacacaagattatacattccgtggagaaaccatataaatgcgaagaatgcggaaaagcgtttaatcagagcagccacctgaccagacataaaacgatccacaccggagaaaaaccgtataaatgtgaggagtgcggtaaggcctttatccaatgcagctacttgataagacataagaccatccacactagagagaagcctaccaatgtcaaaaaagtgcccaaactgttgagcaacccacacacgctattagataagacgattcatacgggcgagaaaccctacaaatgcgaggagtgtgccaaagcgttttag

SEQ ID NO: 25804 - DNA, 1512 bp, Artificial Sequence
  Description of Artificial Sequence: Synthetic coding sequence
atgggagccctgacctttcgggacgtggccattgagttttctctggaggaatggcagtgtctggacaccgagcagcaaaacttgtacagaaatgtcatgctggacaattataggaatctggtctttttaggcattgctgtgtccaagcccgatttaatcacttgtttggaacaggaaaaggagccatggaatcttaagactcatgacatggttgccaagccccctgtgatttgtagtcacatcgcacaggatttgtggccggagcaggggatcaaggattatttccaggaagttattctgcggcagtataaaaaatgtcgtcacgagaacctgctgctccgtaagggctgcaagaatgttgacgagtttaaaatgcataagaagggctataacaggcacaatcaatgcctaacaaccagccatagcaaaatctttcagtgtgacaagtatgtgaaggttttccacaaattcagtaacagtaatagacacaagattcggcatactagcaaaaaacccttcaaatgcaaagaatgtggcaagttgttttgcatcttatctcatctcgctcagcacaagaaaatacacacaggagagaagtcatacaaatgtgaagagtacggaaaagcctttaacgagtctagtaactgcactacacacaaaagaataaccgaaaaaaaaccttacaagtgtaaagagtgcggtaaggccttcaactggtttagccacttcacaacccacaaacggattcataccggggagaagccctaccagtgtgagaagtgcggcaaatttttcaaccagagcacaaatttgaccacacataaacgcatccacaccggcgagaaaccttataagtgtgaggaatgtggaaaggcctttaatcaaagctccaacctcaccgagcataagaaaatacacaccaaagaacaaccttacaaatgtgagaagtgtggcaaggcatttaaatggtcgagtactcttaccaagcacaagaggattcataacggagaaaaaccttacaagtgtgaggagtgtggtaaggccttcaaccgttccagcacccttaaccggcataaaataacgcacacgggaggcaagccatacaaatataaagagtgtgggaaagctttcaatcagtcaagcactcttaccatccacaagatcatccacacagtcgaaaagttctacaagtgcgaagagtgcggcaaggctttctcccgtatctcacatcttactacgcacaagagaatacacaccggtgagaaaccttacaagtgtgaggagtgcgggagggccttcaatcagagctccaccctgaccactcacaagaggatccacactggcgagaaaccttacgaatgtgaagaatgcggcaaagcattcaatagatcttctactcttacaacccacaaaatcatacactcgggtgaaaaaatttacaagtgcaaagagtgtggaaaagcattccgcaggttctcccatctgacacgacataagacaatccacacgtag

SEQ ID NO: 25805 - DNA, 1758 bp, Artificial Sequence
  Description of Artificial Sequence: Synthetic coding sequence
atggagcttctgacatttcgagacgtcgcaatcgagttctcccccgaggagtggaaatgcctcgatccagctcagcagaacctctatagagacgtcatgcttgagaactataggaacctgatcagcctgggtgtggccatctctaatcccgatctggtgatataccttgagcagcgtaaggaaccttataaagttaaaatccatgaaaccgtggcaaagcacccagctgtgtgttcacactttactcaggactttttgcctgtgcaagggattgaggattcgtttcacaaactaatcttgcgtcgctacgaaaaatgcggccacgagaatctcgaactgaggaagagctgcaagagaaaagtgcaaaagggcggatataatgaatttaaccagtgcctctctactattcagagtaaaatcttccaatgtaatgtccatgtcaaagtgtttagcaccttttctaactcaaaccagagaagaatccgccacaccggggagaagcattttaaggaatgtggcaagtcattccagaaattttcagaccttacccagcaccaaggcatccacgccggagaaaagccctatacatgcgaggagtgcggtaaagacttcaagtggtacctgatctttaacgaatatgagatcattcatactggggagaaaccgtttacatgcgaggaatgcggaaacatctttaccacatcttcaaattttgctaagcacaaggtgcatacaggcgaaaaatcctacaagtatgaagagtgcggcaaggcgtttaatagatcaagcacccttaccaagcataaaaggatccacgccgaagaaaagccgtttacttgcgaggagtgtggcaaaatcattacaagctcttcaaacgtggccaaacacaagaagattcacacaggcgagaaactgtacaaatgccaagagtgcgggaaggtttttaacaggtccactaccctcacgaagcacaacagaatccacaccggagaaaagccgtacacgtgtgaagagtgtggcaaagcattctctagatcttctgtccttaacgagcacaagaggatccataccggagaaaagccatacaaatgcgaacagtgcggaaaggctttcagacagagcgccacgctcaataagcataagagtatccacacaggagagaaaccttatacttgcgaagaatgcggcaaggccttctccagattcactaccctgaatgagcacaaaagaattcacactggagagcgcccacacaaatgcgaggaatgcggcaaagcatttggttggtcgacggatctcaataaacataaaattattcacacaggcgagaaaccttacaagtgcgaagaatgcggcaaggcatttggatggtcagcatacctctcaaaacataaaaagattcacactggggaaaagccgtacaggtgcgaagagtgcggcaaagcatttttgtgcagtcgcgcattgaacaagcacaagacaatccacaccggcgagaaaccctatgagtgcgaggagtgtgggaaagcttttggctggtccacttacctgtcaaaacacaaaaaaatccataccggtgagaaaccctacagatgtgaagagtgcgggaaagcattcagacggtcccgcgttctgaacaagtataaaacaattcacacaggagataagacccccaagtgcaagggctgcggcaaggcgttcaagtggtccagctacctgaaccagcataataagatctacacaggggaaaagctgtag

SEQ ID NO: 25806 - DNA, 1284 bp, Artificial Sequence
  Description of Artificial Sequence: Synthetic coding sequence
atgggcgttctgacctttagggacgtggccgttgaattctcacctgaggagtgggagtgcctcgactccgctcagcaaaggctctatagggacgtaatgttggaaaactatggaaatctggtgagtctgggtctggctatcttcaaaccggacctcatgacctgccttgagcagaggaaggaaccttggaaagtgaaaaggcaggaggccgtggcaaagcaccccgctggcagcttccacttcaccgccgaaatattgcccgaccacgatattaaggatagctttcaaaaggtcattctgaggaagtacggctcctgcgaccttaataatctgcatctcaaaaaagactaccagtctgtaggtaactgcaagggacagaaatcctcatataatggtctgcatcagtgtctcagcgccactcattctaagacttgtcagtgtaacaaatgcggtagggggttccaactatgctcaatttttacagaacacaaggatatctttagccgggagaaatgtcataagtgcgaggagtgcggtaaagactgtcgactcttcagtgacttcactcgacacaaaaaaatacacacggtcgagaggtgttataaatgtgaagagtgcgggaaagcttttaagaagttcagcaatctgactgagcacaagagagtgcacaccggggaaaaaccttataaatgcgaaggttgtggcaagacattcacttgcagtagtacgctggtcaaacacaagcgtaatcacactggcgacagaccttataagtgcgaggagtgcgggaaggccttcaagtgcttttcggatctgactaaccacaagcgaatacacacaggggaaaaaccttataagtgtgaagagtgtaacaaagcatatcgctggttttcagatctggccaaacataaaatcatccatacaggtgataaaccatacacgtgcaatgaatgcgggaaggcattcaagtggtttagcgcattatcaaagcacaaaaggatacataccggggaaaaaccatacatttgtgaggagtgcggaaaagcctttacgcggagctcaactttgttcaatcacaagaggatccacatggaggagcgaccatacaagtgcgaggagtgcagcaaaacatttaagtgcttttccgaccttacaaaccataaacgaattcatacaggggaaaaaccttataagtgtgaagaatgcggaaaggcttcctcatggtttagccacctgatcagacataagaggatccatactcgggaaaagctgcacaaatgctag

SEQ ID NO: 25807 - DNA, 1284 bp, Artificial Sequence
  Description of Artificial Sequence: Synthetic coding sequence
atgggagttttaacattcagggacgtggctgtcgagttctcacccgaggaatgggaatgcctcgactcagctcaacaaaggctgtaccgcgacgtgatgttggaaaactatggcaatctcgtctctttaggactcgcgatcttcaaacccgatctgatgacatgtttggaacagagaaaggaaccatggaaagtgaagcgacaggaagctgtggcgaagcacccggcaggatcattccatttcacagcagagatactcccagaccatgatattaaggactcctttcagaaggtgattctgcggaagtatggctcctgtgacctgaacaacctgcatctgaagaaggattatcaatccgtcggcaactgcaaggggcagaaatcatcttacaatggtttgcaccaatgtctgtccgcgacacattctaagacttgccagtgcaacaaatgcggacggggttttcagttatgcagtatctttaccgaacacaaggacatcttttcaagggaaaagtgccataagtgtgaggaatgtgggaaagattgtcgactattctcggatttcactcgacacaagaagattcacacggtagagcggtgctataaatgtgaggagtgtggcaaggcatttaagaaattctccaacctgaccgaacataaacgagtgcacaccggggaaaagccctacaagtgtgaggggtgtggcaaaaccttcacctgcagctcaaccctggtaaaacataagaggaatcacactggggatcgaccctacaaatgcgaggagtgtggtaaagcctttaaatgcttctcagacctgaccaaccacaagcgcattcacaccggagaaaagccatacaaatgcgaagagtgtaataaagcttatcgctggttctccgatttagctaagcataaaatcatacatactggggacaagccgtatacttgtaacgagtgcggtaaggccttcaaatggttcagtgccctctccaaacacaagcgcatccatacaggcgagaagccatacatctgcgaggaatgtgggaaagctttcacccggtctagtaccctgttcaaccacaaaaggattcacatggaggagcgcccatataagtgcgaggaatgtagtaagacctttaagtgttttagcgatctcacaaatcataagcgcatccacactggagaaaaaccctacaaatgtgaggagtgcgggaaggcctcctcttggtttagccacctgatccgacacaaacggattcacacgagagaaaaattgcacaaatgttag

SEQ ID NO: 25808 - DNA, 414 bp, Artificial Sequence
  Description of Artificial Sequence: Synthetic coding sequence
atggacgacctgaggtacggggtgtacccggttaagggagcatctgggtaccctggggctgagagaaacctccttgaatactcatatttcgagaaaggccctctgacattccgcgatgttgttatcgaattttctcaggaggaatggcagtgtctcgacaccgcgcaacaggacctctaccggaaagtcatgcttgaaaatttccggaacctggtctttctaggcattgatgtttccaagcctgatctcatcacctgcctcgaacaggggaaggacccatggaatatgaagcgtcacagcatggtggctactccacccgaaagcggggtgcttaaattccccacaatcattatccttttgagtaggtgttttttccagagcgttaacatatgctttatttaccttgagccatag

SEQ ID NO: 25809 - DNA, 354 bp, Artificial Sequence
  Description of Artificial Sequence: Synthetic coding sequence
atggatgatttgaggtatggggtttatcctgtgaagggggcaagcggttaccccggtgcagagcggaacctcttggaatactcctactttgaaaagggtccactaacgttcagagacgttgttatagaattcagtcaggaggagtggcagtgcctggacactgctcagcaggacttgtacaggaaggtgatgttagaaaattttagaaacctggtgtttcttggaatcgacgtgtccaagccagacctcatcacctgcctggagcagggcaaagacccctggaacatgaagcgacatagcatggtggcaaccccgccagacggcgtttcgctgctctttcctcgcccagaatag

SEQ ID NO: 25810 - DNA, 582 bp, Artificial Sequence
  Description of Artificial Sequence: Synthetic coding sequence
atggcccaggcctcactgctcgcctgtgaaggcctcgctggagtgtcacttgtgccaactgccgcatccaagaaaatgatgcttagccagatcgccagcaagcaggcggaaaatggcgagcgtgcaggatccccagatgtgctgcgttgctcctcccagggccaccgaaaagactcagacaaatcgagatcgaggaaagacgatgactccctttcagaggcttctcacagcaagaaaactgttaagaaggtggtggtagtggaacaaaatgggtcctttcaggtcaagatccccaagaacttcgtctgtgagcattgcttcggtgccttcagaagctcataccacctgaaacgacatattctgatccataccggagagaagccatttgaatgcgatatctgcgacatgcggttcatacaaaaatatcatctggaacgacacaagcgtgtccattctggcgagaagccataccagtgtgaaagatgccaccagtgtttctctcgaactgaccgcctcctacggcacaagaggatgtgtcagggctgtcaatcaaaaacctctgacggccaattcagtctgtag

SEQ ID NO: 25811 - DNA, 2337 bp, Artificial Sequence
  Description of Artificial Sequence: Synthetic coding sequence
atgaacctcaccgaagactgtatggtgttcgaggacgtggccatctactttagccaagaggagtggggtatcctcaatgacgcccagagacatctgcattcaaatgtgatgctcgaaaacttcgcactcctctcttctgtcggttgttggcatggggctaaggacgaggaggtgccatccaaacagtgcgtttcggtcagagtcctgcaagtgaccattccaaaacctgctctgtcgacgctgaaggctcagccttgtaaaatgtgttcgtcaattttgaaggacatattacatttggcggagcatgacgggacccatccagaacagggcttgtatacctgcgctgcagaacacgacctccaccagaaagagcaaattcgggaaaagctgacaagaagcgatgaatggaggccttcattcgtgaatcactcagcccatgttggggaacgaaatttcacctgcacacaggggggtaaggactttactgctagctccgacttactgcagcagcaggtcttgaattcaggctggaagctctacagagatactcaggacggggaggctttccagggagagcagaacgacttcaactcttcacaggggggaaaagacttctgccatcagcacggcctgtttgagcaccagaaaactcacaatggggagcgcccttatgaattctctgagtgcggggagctgtttaggtacaatagtaatcttataaagtatcagcagaatcacgccggagaacgcccatatgagggcacagagtacggaaagacctttattaggaagagcaaccttgtccagcatcagaagatccactccgagggatttctgtccaaacggtcggatccgattgaacatcaagagattctgtcgcgccctacgccttacgagtgcacccagtgtggtaaggcatttttaacccaggctcacctcgtggggcaccagaaaacccacactggggaacaaccttacgaatgcaacaagtgcggaaaattctttatgtataactctaagcttattcgtcatcagaaggttcacactggcgaacgtcggtacgagtgctccgagtgtgggaagttgtttatggacagctttacactggggaggcaccaaagagttcacactggcgaaaggccctttgagtgctctatatgcggaaagttctttagccatcgatctacactgaatatgcatcagagagttcacgccggaaagcgcttgtataagtgtagtgaatgtgggaaggcctttagtctgaagcataatgtcgtgcagcacctaaagatacacaccggagaacggccttacgagtgcactgagtgcgagaaggctttcgtacggaaaagccatttggtgcagcatcagaaaattcacacggacgcattttcaaagcgcagcgatctcattcaacacaagcgcatcgacatcagacccaggccttacacatgctccgagtgcggaaaggcttttctgactcaagcgcacctggttggccatcagaaaatccataccggtgaacggccatatgagtgcacccagtgcgccaaagcgttcgtgcgtaagtctcatctggtgcagcatgagaagatccacaccgacgctttcagtaaacgctcagaccttatccaacacaagcggatcgacctcaggcctcggccttacgtgtgttcagagtgcggtaaagcgttccttacccaagcgcacttggacggtcatcagaagatacagacaggcgaacggaggtacgaatgtaatgagtgcggtaagtttttcctggactcgtacaaactagtcattcaccagcgcattcacacaggcgagaaaccctataaatgcagtaagtgcggcaagttcttcaggtaccgctgtaccctgtccagacaccagaaagtgcatacaggggagaggccttacgaatgttctgaatgtggtaagttctttagggatagttataaactgatcatccatcagcgcgtacacacaggagaaaagccatatgagtgttctaactgtggaaagtttctgcgctatcggtccacctttataaaacaccataaagtgtgcacgggggagaaacctcatgagtgctcgaagtgtcgtgagctcttccggacaaagtccagcctgattattcaccagcagagccatacgggagagtcgcccttcaagttgcgcgaatgtggaaaagatttcaacaaatgcaatactggacaaagacagaagacacatacaggcgaaagatcttacgaatgtggggaatctagcaaggtctttaaatacaacagctccttgatcaaacaccaaatcatccacaccggcaagaggccctag

SEQ ID NO: 25812 - DNA, 1194 bp, Artificial Sequence
  Description of Artificial Sequence: Synthetic coding sequence
atgatgttccaggaccccgtcgcttgtgaagacgtggcggtaaactttacacaggaggaatgggctctcctcgatatcagtcagcggaaactgtatcgcgaagtcatgctagaaacatttagaaacctcacatccataggaaaaaagtggaaggatcagaacattgagtacgagtaccagaaccctaggaggaattttcggtctctcattgaaggcaacgtgaacgaaatcaaggaagattcccattgtggagagacattcacccaggtgccagacgaccggctgaactttcaagaaaagaaggcctcccctgaagctaagtcctgcgacaacttcgtctgtggcgaggttgggatcgggaactcaagcttcaatatgaacattcgtggagacattggacacaaagcgtacgaataccaggactacgctcctaagccctacaagtgccagcaaccgaaaaaggcttttcgctatcaccctagtttcaggacacaggagcggaatcatactggggaaaaaccatacgcctgcaaggaatgtgggaaaacctttatctcgcacagtggtattcgcagacggatggttatgcactcaggagatggcccatacaagtgtaagttttgcggcaaggcagtgcattgtctgagactgtacctcatccatgagaggacacacacaggggaaaagccttacgagtgcaaacagtgtgtgaaaagcttctcctactctgcaacacaccgtatacatgaacgtacacacactggggaaaaaccctacgagtgccagcagtgtggaaaagcctttcactccagctcctcctttcaagctcataagcggacccacaccgggggaaagccctacgagtgtaaacagtgtggaaaatcgttctcatggtgtcatagctttcagatccatgaaagaactcacacaggagagaagccttgcgaatgttccaaatgtaacaaagcctttaggtcttaccgctcctatcttcggcacaaacggtcccacactggagagaaaccctaccagtgcaaggagtgtcggaaagccttcacctatccttcatccctcaggaggcatgagcggacccactccgctaaaaaaccctacgaatgcaagcagtgtggtaaagcgctaagttataaattcagcaatactccaaagaatgcactgtggagaaaaacactatag

SEQ ID NO: 25813 - DNA, 1185 bp, Artificial Sequence
  Description of Artificial Sequence: Synthetic coding sequence
atggatcccgtcgcttgtgaagatgtggcagtgaatttcacccaggaggagtgggcgctgttggacatcagccagcgcaagctttatagagaggtaatgctcgagacgtttagaaatctgacatccattggaaaaaaatggaaggaccagaacatcgagtacgaatatcagaacccgaggcgcaactttcgttcactgatcgaggggaacgtgaatgagatcaaggaggacagccattgcggcgagaccttcactcaagtccccgatgatcggctcaatttccaggagaagaaggcttcgccagaggccaaatcttgtgataatttcgtgtgtggcgaggtgggaatcggcaactcatccttcaacatgaatatccgtggtgacattgggcataaggcttacgagtaccaagactacgccccaaagccctacaagtgtcagcagccgaagaaggcatttaggtaccatccatctttcaggacccaggagagaaaccacactggagagaaaccttatgcctgcaaggaatgcgggaagacattcatcagccacagtggcatcagaagacgcatggtgatgcattcaggtgacggaccatacaagtgtaagttttgcggcaaggcggtgcactgtcttaggttgtatctcatccatgaaagaactcacacgggtgagaaaccttacgaatgtaaacaatgcgtgaagtctttctcatactcagcaactcaccgcatccacgagcgcacccatacaggggaaaaaccttacgagtgtcaacagtgtgggaaggcgttccattcttcctctagcttccaggcacacaaacggacacataccggcggtaaaccgtacgaatgtaaacaatgtggaaagtcgttctcctggtgccactcatttcagattcatgaacgtacccacacaggggaaaagccttgtgaatgttctaaatgtaacaaagccttccgaagctaccggagctacctccgccacaagcgtagccacaccggtgaaaaaccctaccaatgcaaggaatgtagaaaggcgtttacataccctagctcgctgcgacgtcatgaacgaacacacagtgccaagaagccctacgaatgcaaacaatgcggaaaggccttgtcctacaaattcagtaatacgcccaaaaatgctctttggaggaaaacactgtag

SEQ ID NO: 25814 - DNA, 1245 bp, Artificial Sequence
  Description of Artificial Sequence: Synthetic coding sequence
atgccttgctgcagccatcggagttgtcgcgaagaccccggaacctctgagagtcgggagatggaccccgtcgcctgcgaggacgtggcagtgaacttcacccaggaagagtgggctctgttggatataagccaacgcaagctctaccgcgaggtgatgttagaaacttttcgcaacttaacctccattggcaagaagtggaaagaccagaacatcgagtatgaataccaaaaccccaggagaaatttcagatccttaatcgaagggaacgtgaacgagatcaaagaagattcccattgcggcgagaccttcactcaggtcccagatgataggctcaacttccaggagaaaaaggccagtccagaagccaaatcctgtgataacttcgtgtgtggggaggttggaattgggaacagctcgtttaacatgaacatccgcggtgatataggacacaaggcctatgagtaccaggactacgctccaaaaccctacaagtgtcagcagcctaagaaggcgtttcgatatcatccaagtttccgtacccaggaaagaaatcacactggtgaaaagccctacgcttgcaaggagtgcggaaagacattcatatcccactccgggatccgcaggcgtatggtcatgcatagcggtgacggaccgtacaaatgtaagttctgcggcaaggcagtgcactgtctgagactgtatctgatccacgaaagaactcatacaggggagaagccgtacgagtgcaagcagtgcgtgaaatccttttcatatagcgctacccatagaattcatgaacggacgcataccggtgagaagccctacgagtgtcagcagtgtggtaaagctttccactcaagcagcagctttcaggcgcataagcgaacccatacggggggtaagccctacgaatgcaaacagtgcgggaaatcattctcctggtgccacagcttccaaatccacgagaggacacataccggtgagaagccttgcgagtgcagtaagtgtaataaggcctttagaagttaccgttcgtatctgcggcacaaacgtagtcacacgggggaaaagccatatcagtgtaaagagtgtagaaaggcttttacctacccaagcagcctgaggcggcacgagcgaacccactctgctaaaaaaccatatgaatgcaaacagtgtggcaaagctctttcctacaagtttagtaatacccctaagaacgcactgtggagaaagacactatag

SEQ ID NO: 25815 - DNA, 819 bp, Artificial Sequence
  Description of Artificial Sequence: Synthetic coding sequence
atgaacattcgcggagacattgggcacaaggcatacgaataccaggattacgcgcctaaaccctataaatgccaacagcccaagaaagccttcaggtaccatcccagtttccggacccaggagagaaatcacaccggagaaaaaccctacgcctgcaaggagtgtggaaagacattcatctcacatagcggcattaggcgtaggatggttatgcacagtggagacggcccttacaagtgcaagttttgtggaaaagccgttcattgcctgagactctatctcatacacgagagaactcacactggagagaaaccttacgaatgcaaacaatgcgtcaagtctttcagttattccgccacacatagaattcacgaacgcacgcacactggtgagaagccctacgagtgccagcaatgtggtaaagcctttcactcaagtagtagctttcaagcacacaagaggacacacaccggcggtaaaccctatgagtgcaaacagtgtggaaagtccttcagttggtgccattccttccagatccacgagaggacccatacaggcgagaagccatgtgaatgttcaaagtgtaataaggcatttagatcttatcgcagctacctgcgccacaagagatctcacaccggtgagaagccctatcagtgcaaagaatgccgtaaagcctttacctaccctagctcactgagacgtcacgagcgcacccacagcgcaaagaagccttatgagtgcaaacagtgcggaaaggccctaagctataagttcagtaatacacccaagaatgcattgtggagaaagactctgtag

SEQ ID NO: 25816 - DNA, 1227 bp, Artificial Sequence
  Description of Artificial Sequence: Synthetic coding sequence
atggcgccaccgctcgccccattgccacctagggatccaaatggggctgggcctgaatggcgcgagccaggggctgtgtcttttgccgatgtagccgtttatttttgccgcgaggagtggggatgtctgagaccggctcaacgagctctgtacagggatgttatgcgggagacctatggccacttgtccgcccttggcatcggcggaaacaagcctgcgctgattagttgggtggaggaggaggcagagctgtggggccctgccgctcaggaccccgaagtggcgaagtgtcaaacgcagacggacccagcagactcaaggaacaagaagaaagaacgacagcgcgagggcacaggagctctggagaagcccgaccctgtggccgctggctcaccaggcctgaaatctcctcaggcacctagcgcaggacccccatatggttgggaacagctgtctaaagcaccacatagaggacgcccttcactatgtgcacaccctcccgtacccagggctgaccagcgacacggatgttatgtatgcggaaaatccttcgcgtggaggtcaaccctcgtggagcacgtatattcacatacgggcgagaagccattccattgtactgattgcggcaaagggtttggacatgcgagttctctctccaaacatcgggctattcacaggggcgaacgtccgcatagatgccttgagtgtggcagagcctttacccagagaagcgctctgactagccaccttcgcgtccacaccggggaaaaaccttacggctgtgcagattgcggacgtagatttagccagtcaagcgctttgtatcagcatagaagagtgcacagcggcgagactcctttcccctgccccgactgcgggcgagctttcgcttatccttcggatttgagacggcatgtcaggacgcacactggggagaagccctacccatgtcctgactgtggaaggtgcttccgacaaagctctgagatggcagcacacagacgaacccactccggcgaaaaaccatatccatgtccacaatgcgggcgacggttcggacagaagtccgcagtggccaagcaccaatgggttcaccgccctggcgcaggcggtcaccgcggacgcgtggccggacggctgagcgtgacactaacgccagggcatggggatctagatccaccagtgggcttccagctctacccagagattttccaggagtgcggatag

SEQ ID NO: 25817 - DNA, 1224 bp, Artificial Sequence
  Description of Artificial Sequence: Synthetic coding sequence
atggccccacctctggcaccattgccaccaagagatccaaacggagctggaccagagtggcgagagccaggagccgtgtccttcgccgacgtagccgtctatttctgtcgagaagaatggggttgtctacgccctgcacaacgagctttatatcgcgacgtgatgcgggagacatacggacatctgtctgctttgggcatcgggggaaataagcctgcactaataagttgggtcgaggaagaggcggaactgtgggggcctgcggctcaagacccagaggtggccaagtgccagactcagactgatcccgactcgcgcaataagaagaaagaacgccagagagaaggtaccggagccctagagaaacctgaccccgttgcagccggatcccctggccttaaatctcctcaggcccctagtgccggacctccctacgggtgggagcaacttagtaaggcaccccacagaggcaggccctccctatgcgcacacccacctgtcccaagggccgaccagcgtcacggctgttacgtatgcgggaaaagctttgcatggagatccacccttgtcgagcatgtgtactctcatactggagaaaaacccttccactgcacagattgtggcaaggggttcgggcatgcctcatccctgagcaaacaccgtgccatccatcgcggagagcggcctcatagatgccttgagtgcggtcgagccttcacccagcggagcgccttgacgagccacctgcgagtccacaccggagaaaagccctacgggtgcgctgattgcggtcggagattcagtcaatctagcgctctgtaccagcacaggcgtgtgcacagtggagagacaccttttccctgccctgattgtgggagggcctttgcctatccctccgatcttcgcaggcacgtgcgcacccatacaggggagaagccatacccctgcccggactgcggaaggtgcttcaggcagtcctccgagatggcggcacatcgcaggactcacagcggcgagaagccctatccttgtccacagtgcggccgtcgtttcgggcagaagagtgcagtggccaaacaccaatgggtgcacagacctggggcaggcggacatagggggagggttgccggtaggttatcggttacgttgacgcccggacacggcgacctggatccacccgtcggatttcagttgtatccagaaatctttcaggagtgcgggtag

SEQ ID NO: 25818 - DNA, 21 bp, Artificial Sequence
  Description of Artificial Sequence: Synthetic coding sequence
atgatgaaggagtttagctag

SEQ ID NO: 25819 - DNA, 1572 bp, Artificial Sequence
  Description of Artificial Sequence: Synthetic coding sequence
atggcacttccccagggactactgacttttagggacgtggctatcgagttcagccaggaagagtggaaatgtctggatccagcccaaagaaccctctatcgtgacgtcatgctagaaaattacagaaatctcgtgtctttggatattagctccaagtgtatgatgaaggagttctcaagtacagcgcaggggaaccgagaggtatttcatgcgggaacatcacagagacacgagagccaccacaatggagatttttgcttccaggatatagataaggatattcacgatattgagtttcaatggcaggaggacgaacgaaatgggcacgaggcactgatgactaagattaaaaaactgaccgggagcacggagcgctacgaccagaattatgccggaaacaaacccgtcaagtaccaactgggtttttcttttcattcacaccttcctgaactgcacattttccatactgaagaaaaaattgataatcaggtggttaaaagcatccacgacgcaagcctcgtttccaccgcccagcggatctcctgccggcctgagactcatatctcgaacgattatggcaacaactttttgaattcttccctctttacccagaagcaggaggtgcacatgcgagagaagtccttccaatgtaacgattccggcaaggcctacaattgctcgagcctgttaaggaagcatcagttgatacatctgggcgagaagcagtacaagtgtgatatctgtgggaaagtattcaactccaagcgatatgtcgctcggcaccgacgctgtcataccggggagaaaccttacaagtgtaatgaatgcggaaagacgttcagtcagacatactacctaacgtgccacagacgattgcacaccggcgagaaaccatacaagtgtgaggaatgtgataaggcattccactttaagtccaagcttcagattcatcggaggatacacacaggagaaaaaccctacaaatgcaatgagtgcgggaagaccttctcacagaagagttatctgacctgccacaggaggctccacactggcgaaaagccttataagtgtaatgagtgtgggaagactttctcccgcaagtcccactttacttgccaccatagagttcatactggggaaaaaccttacaagtgcaacgaatgctctaaaacattttcccataagagtagcttaacttaccacaggcgactgcacacagaagagaagccatataagtgcaacgaatgcggcaaaacgttcaaccaacagttaacactcaatatatgtagactgcactccggggaaaaaccctataagtgcgaagaatgcgacaaagcctacagctttaagagcaatctggaaatccaccagaagatccatactgaggaaaacccatataaatgtaacgagtgcgggaagacctttagccgaacttcctccctgacctaccaccacagactgcacactgggcagaaaccatacaaatgcgaggattgcgacgaagcttttagttttaaaagtaatctggaaaggcaccgcaggatctatacgggcgagaagctccatgtctag

SEQ ID NO: 25820 - DNA, 387 bp, Artificial Sequence
  Description of Artificial Sequence: Synthetic coding sequence
atgatgaaggaattcagcagcaccgcccaggggaaccgagaggtgtttcacgccggtacttcgcagagacatgagagccaccacaacggcgacttttgcttccaggacattgacaaagacattcatgacatcgagttccagtggcaggaggacgaacgtaacggtcacgaggctttgatgacaaagattaagaagctgacgggatctaccgaaagatatgaccagaactacgcaggtaataagccagtgaaataccagctcggcttcagtttccacagccatctgccagagttgcatatctttcatacagaggaaaaaattgacaatcaggtggttaagtctatccacgatgccagcctggtctcaaccgcacaacggatctcatag

SEQ ID NO: 25821 - DNA, 1416 bp, Artificial Sequence
  Description of Artificial Sequence: Synthetic coding sequence
atgctgtgtgagggagaagcacaaaaacgtaaggctgaagaatccggaatgcccctcactcaaggtcatctaaccttccgggatgttgctattgaatttagccaggaggaatggaaatgcttagaccccgttcaaaaagcactgtacagagatgtcatgctcgagaactacagaaatttagtgagtcttggcatttgtctgccagatctctctatcatttcaatgatgaaacagcgcactgagccttggacagtggaaaacgaaatgaaagtggccaagaatccagaccgctgggagggaattaaagatattaataccggtaggtcttgtgcagtgagaagcaaagcgggaaataagcctatcacaaatcagctgggcttgaccttccagctgccactgccagagttggagatctttcaaggtgagggtaaaatttacgagtgcaaccaggttcagaagtttatttcacactctagctccgtctctcccctgcagagaatttattctggggtgaagacacatatttttaacaaacaccgaaacgactttgtagacttccccttgctcagccaggagcagaaggcccacatcagacgcaagccctacgagtgtaacgagcaggggaaagtgttcagagttagctcaagcctgcccaaccaccaagtcatccacactgctgacaaacccaaccgatgtcacgagtgcggcaagacggttcgagacaagtctgggctggctgagcattggcggattcggacaggcgaaaaaccttacaaatgcaaagaatgcggaaagcttttcaaccggatcgcttacctagcccgtcatgagaaggtacacactggcgaatctccttacaaatgcaatgagtgtgggaaagttttttccaggatcacctaccttgtgagacaccagaaaattcataccagggaaaagccgcataaatgtaataagtgcggaaaggtttactcatcctcaagttatctcgctcagcactggagaatccatacgggggaaaaactgtacaaatgcaataaatgtggcaaggagttctccggccactccagcctgaccacccacctcctgatccacaccggcgagaaaccctacaaatgtaaggaatgcgataaggcattcagacataagtttagtctcacagtgcaccagcggaaccataatggcgaaaaaccgtacaagtgccacgaatgtggcaaagtgtttacccaggtgagccacctggcccgtcatcagaagattcataccggtgagaagccatacaagtgcaacgagtgcggaaaagtattcactcagaactcccacttggcgaaccaccagcgtattcacactggagagaaaccatataagtgtcacgtgtgcggcttatctctttggtctgggaaagagagtgtgcgttag

SEQ ID NO: 25822 - DNA, 1407 bp, Artificial Sequence
  Description of Artificial Sequence: Synthetic coding sequence
atggcacagctgcggagagggcatctcacatttagggacgtggctatagagttctctcaagaagaatggaaatgcctggaccccgtacaaaaagctctctacagggacgtaatgcttgaaaactatcggaatctagtcagcttaggtatttgtttaccagacctgtctattatcagcatgatgaagcaacgcacagaaccgtggactgtggagaatgaaatgaaagttgccaagaatcccgatcgttgggagggcataaaggatatcaacaccggacgcagctgtgcagtgaggtcgaaggcaggcaacaaaccaataactaaccagctgggcctgacattccagttgccactgcccgagttggagatcttccagggcgagggtaagatttacgagtgcaatcaagtccagaagttcatttcacactctagttctgtttcaccacttcaacggatttacagcggtgtgaaaacacacatttttaacaagcatcgcaatgattttgtggactttcccttgctcagccaggagcaaaaagctcacatacgccgtaagccttatgagtgcaacgagcaaggtaaggtctttcgtgtgagttcatctctaccaaaccaccaggtcatccacactgctgacaaaccgaataggtgtcatgaatgcggcaagaccgtgcgtgacaagtccgggctcgccgagcattggcggataagaacgggcgagaaaccatataagtgtaaggagtgtgggaagctcttcaacagaattgcctacctggcacgccatgagaaggtgcacacaggtgaaagtccatataaatgtaatgaatgcgggaaggtcttcagcagaataacttatcttgtgagacaccagaagattcacactagggagaaaccacataagtgcaacaagtgtggaaaagtgtattcatcaagcagttatctagcacagcactggcggattcataccggagagaaactctacaagtgcaacaaatgcggaaaggaattttcaggacacagcagcctgacaacacacctgctaattcacacaggtgagaagccgtataagtgcaaggagtgcgacaaagcctttaggcataagttcagtctaactgtgcatcagcgaaatcacaatggcgagaaaccctataaatgccatgagtgcggtaaggttttcacacaggtgtcacatcttgccaggcatcagaaaatccatacgggtgaaaaaccatataaatgtaatgaatgtggcaaggtctttacccagaacagccacctcgcaaaccaccagcgcattcatactggcgaaaagccgtacaagtgccacgtttgcgggaaagtgttcagacactcctcttggttcgtacaacaccagcgcagtgtacacgagcgcgtcctaactaactag

SEQ ID NO: 25823 - DNA, 1623 bp, Artificial Sequence
  Description of Artificial Sequence: Synthetic coding sequence
atggagcgggaggccttaccttgggggctcgagccccaggatgtgcagtcatctgacgagatgaggagccccgagggctacctgcgcggaaatatgtcagagaacgaggaggaagagatcagccagcaggaaggctccggggattatgaagtggaggagatcccctttggcctcgaacctcagtcccccggatttgagcctcagtctccagagttcgagccacagtcacctcgattcgagcccgaatccccagggttcgaaagtcgctctccaggcttagtccccccttctcctgagtttgcacctaggagcccagagtccgattctcagtctcctgaatttgagagtcaatctcctagatacgagccacagtccccaggatatgaacctaggtcaccaggatacgaaccacggagtcctggctacgagtccgaatctagccgctacgagtcacagaatactgaactcaagacacagtcaccagaattcgaggcccagtcctccaaattccaggaaggtgcggagatgctactgaaccccgaagaaaaaagcccgttgaacattagcgtaggggttcaccccctcgattccttcacccaaggctttggcgagcagccgaccggggatttgcctattggccctccctttgaaatgcctactggcgcactcttgtctacaccacagttcgaaatgctgcagaatcccctgggattgacaggagcactgcggggaccaggcaggaggggtggaagggcacggggtgggcaggggcctcggccaaatatctgcgggatctgcggaaaatcctttgggaggggatctacgttgatacaacaccagcggatccacactggggaaaagccctacaagtgtgaagtctgttcgaaagcatttagtcagtccagtgacttgataaaacaccagcgcacgcacaccggtgagagaccatataaatgccctcggtgtgggaaagccttcgccgactcaagctatctcctgcgccaccaacgcacacactcaggccagaagccatataagtgcccacattgtgggaaggcctttggcgactccagttatctgttacggcatcagcgcactcactcccacgagaggccctattcctgtacagagtgtggtaagtgctactctcagaattcttcgctgagatcccatcagagagtgcatacgggccagaggccatttagttgcggcatatgtggcaaatccttcagccagcgaagcgctctgattccacacgcgaggtcccacgccagggaaaaacccttcaaatgcccggagtgcggcaagcgctttggccagtcctccgtactggccatccacgcgcgaacccacttaccaggacggacctatagctgccctgactgtgggaagacattcaaccgtagctcaactctcattcagcatcagagaagtcacaccggcgaacggccttatcgctgcgcagtatgcggtaagggcttttgtcggagcagcactcttctccagcatcacagagttcatagcggagaacgcccttacaagtgtgacgattgcgggaaagcattttctcagtcctcggacctgatccgtcatcagcgtacacatgccgctggccgtagatag

SEQ ID NO: 25824 - DNA, 1362 bp, Artificial Sequence
  Description of Artificial Sequence: Synthetic coding sequence
atgtcggaaaatgaggaagaggaaattagtcaacaggaggggagcggggattacgaggtggaagagattccttttgggctcgagcctcaatctcctggctttgagccacagagcccagaatttgaaccacagtccccgaggttcgagccggagtcacccggtttcgagtcacgatccccaggcctggtccctccttcgccagaattcgctccacgctccccagagagcgattcccagagtcccgagttcgaaagccagtctcctagatatgaaccacagtcccctgggtatgaaccaaggtcccccggatatgagccaagatcgcccggatacgaaagcgaaagctcccggtatgaatcacagaatacagaattgaagacccaaagcccagaattcgaagcccagagttccaagttccaggaaggagccgaaatgctgctgaatcccgaggagaaaagtccgctgaatatctcagtaggagtgcatccgctggatagcttcacccagggttttggcgagcagcctacaggtgacctacccatcggcccacccttcgaaatgcccacaggtgctctactctctacgccccagtttgaaatgctgcagaatcctctgggactgacaggcgcactgcgcggacccggaaggaggggaggcagagctagagggggacagggtccaagacctaacatctgcgggatttgcgggaaatcatttggcagaggctccactcttatccaacaccagaggacccactccggtcaaaagccatataaatgcccacattgcggtaaagctttcggggattccagttatttactgcgacaccagagaactcatagtcacgaaaggccatactcatgtactgagtgcggtaagtgctacagtcagaattcttcgttgcggtcgcatcagcgagtgcatacagggcagcgaccgttcagctgtggcatttgcgggaaaagcttctcacagcgctctgctttaataccacacgcaagaagccacgcccgtgaaaaaccatttaagtgtccagaatgtggcaagaggttcggacaaagcagcgtcctcgccattcacgctcggacccatttgccaggcaggacctatagctgcccagattgcggcaagacctttaatagatctagcactttgattcaacaccagcgatcacacactggtgagcggccataccgctgcgcagtatgcggcaagggattttgtaggtctagtaccctcttacaacaccatcgcgtccactccggcgagaggccctacaagtgtgacgattgtggcaaagcgttctcgcaatcatccgacttgatccgacaccagaggacacacgctgccggaagacgctag

SEQ ID NO: 25825 - DNA, 2076 bp, Artificial Sequence
  Description of Artificial Sequence: Synthetic coding sequence
atgatggccgaaaataacttgaaaatgttgaaaattcagcagtgtgtggttgcaaacaagcttccacgaaaccggccttacgtttgcaacatatgtttcaagcacttcgaaactcccagtaagctggctcgtcattatcttattcacaccggacagaaacctttcgaatgcgacgtctgtcacaagaccttccgtcagcttgtgcatctggaacgacaccagttaactcatagtctgccttttaagtgttcaatttgtcagcgccactttaagaatttgaagacgttcgtgaaacaccagcagctgcacaacgagacttatcaaaataatgtgaagcaagtcagacgccttctggaggctaaacaagagaagtctatgtatggagtctacaatactttcaccactgaggagcgctgggcgctgcacccttgtagtaaatctgatcctatgtacagtatgaagagacgtaagaacattcacgcttgtactatttgtggtaaaatgttccccagccaaagcaaattggatcggcatgttctcatacacaccggccagagaccatttaagtgcgtcctttgcaccaagtcctttcgccaaagcacgcatttgaagattcaccagctaacgcacagcgaggaaagaccctttcagtgttgtttctgccagaaggggttcaagattcagagcaagttactaaaacacaagcagatccacactagaaataaggcatttagagcactgttgttgaagaagagaaggaccgagtctaggccactccctaataaactgaacgcaaaccaaggaggattcgagaacggggagattggggaaagtgaggagaataaccctcttgacgttcactcaatttatatagttccgttccaatgtcccaaatgtgaaaagtgtttcgagagtgaacaaattctcaacgagcactcttgtttcgccgctcgaagtgggaaaatcccctcaaggttcaaacgctcttataattataaaaccatcgtcaagaagattctcgccaaactgaagcgcgcaagatctaagaagctcgacaacttccagtcagagaagaaggtgtttaaaaagagcttccttcgcaattgtgacctcatttccggcgaacagtccagcgagcaaacccagcgcacattcgtaggctcactcgggaagcacggtacgtataagacaatagggaacaggaaaaaaaagaccttaaccctgcctttttcatggcagaacatgggcaagaacttgaaaggtattctgacaaccgagaatatcctgtcaatcgataattccgtgaataagaaggacctcagcatttgcggctcttcgggcgaggagttttttaataattgtgaggtgcttcagtgcgggttctctgtgcctagagagaatatcagaactcgtcataaaatatgcccatgtgacaagtgcgagaaggtcttcccatctatttccaaactcaaaagacactatctaattcacactggacagcggccattcggctgcaacatatgtggtaaatcctttaggcagtctgcacacctcaagaggcatgaacagactcataatgagaaatcgccctacgcttccttgtgccaggtagaattcggcaatttcaacaatctgtcgaaccattctggaaacaacgtgaactacaatgcgagccaacagtgccaggctcccggtgttcagaaatatgaggtgtcagaatccgaccagatgtcaggggtaaaagctgaaagtcaggacttcatccccggtagcacaggccagccatgtcttcccaacgtgctcctggagagtgaacaatccaaccccttttgtagttactctgaacatcaagaaaaaaatgatgtgtttctatatagatgtagtgtgtgcgcaaagtctttccgttcaccatccaaacttgagcggcattatctcattcatgcaggccagaaaccgttcgaatgtagcgtctgtggaaagaccttcaggcaggcgccacactggaaacggcatcagctgacacatttcaaagaaaggccccagggcaaggtcgtcgctctggattcagtgatgtag

SEQ ID NO: 25826 - DNA, 399 bp, Artificial Sequence
  Description of Artificial Sequence: Synthetic coding sequence
atgatggccgaaaataatctgaaaatgttaaaaatccaacagtgcgtggtggcgaataagctaccaaggaatcggccatatgtatgcaacatctgttttaagcactttgaaactccttccaagttggccaggcattatcttatccacacaggccagaagccgtttgaatgtgacgtctgtcacaaaacctttcgccagctggtgcaccttgagagacaccagctcacccactcactaccctttaaatgctccatttgtcagaggcacttcaagaatctgaaaacatttgtaaagcatcagcaactccacaacgagacataccaaaataacgtaaagcaagttcgcaggcttctcgaagccaagcaggagaagtcaatgtatggggtgtacaatacctag

SEQ ID NO: 25827 - DNA, 954 bp, Artificial Sequence
  Description of Artificial Sequence: Synthetic coding sequence
atgccaggggagcagcaggctgaagaggaggaggaggaagagatgcaagaggagatggtgctgctagttaagggcgaggaggatgaaggcgaagagaaatacgaagtggtgaagcttaagattcccatggacaataaggaagtgccaggggaggctcctgctccatctgcagatccggcacggcctcatgcgtgtccggattgtggtagagcatttgccaggagatcaaccctggccaagcacgcacgaacccacacgggtgagcggccatttggttgcacagagtgtggcagacgctttagccagaaaagtgcgctgaccaagcacggtagaacacacaccggcgagaggccttacgaatgccccgagtgcgataagagattcagtgcagctagcaatctgaggcagcaccgcagaaggcataccggtgagaagccctacgcttgcgcccactgcggtcggagatttgcccagtctagcaactacgctcagcatctccgggtgcacacgggcgagaaaccttacgcatgtccagattgcggacgagcttttggtggatcctcatgcttggctcgtcaccgacgcacacacaccggtgagagaccctacgcatgtgcggactgcggaaccagatttgcccaaagcagtgcgttggctaagcatcggagagtgcatacaggcgaaaaacctcatagatgcgctgtgtgtggcaggcggttcggacatcgcagcaatctggctgagcatgcgcgtacccacaccggcgagagaccatatccatgcgctgaatgcgggaggcgatttcgcctgagcagccatttcatacggcaccgtcgtgcgcacatgcgaagacggctgtatatctgtgccggatgcggacgggactttaaacttccacccggagcgaccgccgcaactgcgacagaacggtgccctgaatgcgaaggaagctag

SEQ ID NO: 25828 - DNA, 954 bp, Artificial Sequence
  Description of Artificial Sequence: Synthetic coding sequence
atgcctggagagcagcaagcggaggaagaagaagaagaagagatgcaagaagagatggtgctgttggtgaaaggggaggaggatgagggggaggaaaaatatgaggtcgttaagctcaaaataccaatggataacaaagaggtccctggggaggccccagcacctagcgcagaccccgcaagaccccacgcatgccccgattgcgggagagcctttgctaggaggtccaccctggccaagcatgcaagaacacacacaggagaacgccctttcggctgtacggagtgcgggagaagattcagtcagaagtcggctctcactaaacacggaagaacccacaccggggagcgcccatacgaatgccccgagtgcgataagcgcttcagcgcagcatccaatttgcggcagcacagaaggaggcacactggggaaaagccctacgcctgcgctcattgtgggaggagattcgcccagagctccaactacgcccagcatctgcgcgtgcacacaggggagaaaccttatgcctgtcctgactgtggtagagcgtttggaggcagctcatgcctagccagacaccgccgaacacacacgggggaaaggccttatgcatgtgccgactgtgggacaagattcgctcagtcaagtgcactggccaagcaccgaagggttcacacaggcgaaaagcctcaccgctgcgcggtctgtggcaggcgtttcggccacaggtctaatctggccgagcatgcacggacccacactggagaaagaccctacccatgtgcagagtgcggtaggagatttcggctgagctctcactttattcgtcaccgcagagctcatatgcggcgaaggctctacatctgcgctggctgcgggcgtgactttaaattgccgcctggagcgacggctgcaacagcgacagagagatgcccggagtgcgagggtagctag

SEQ ID NO: 25829 - DNA, 1245 bp, Artificial Sequence
  Description of Artificial Sequence: Synthetic coding sequence
atgaattctgaagtcatagtggatcctattcagggacaggttaactttgaagacgttttcgtctatttcagccaggaggagtgggtgctcctcgacgaggctcagcggctgctataccgcgacgtgatgttagaaaattttgcgctgatggcatctctggggcacaccagctttatgagccacatcgtggctagcctggtgatgggcagcgagccgtgggtgccagattgggtcgatatgaccctcgctgtagctaccgggtgttggcacggcatggaggatgaggagatcccattcgagcagtccttctcaattggcatcttttccgctaaccttcatcagcaccaaaagcagcacagcggagagaaacctttcaggtccgataagtcccggccattcctgctaaataactgcgcagtgcagagcatggagatgagcttcgtcaccggcgaggcatgcaaagattttttggcttcatcttcaatcttcgagcaccacgctccccacaatgagtggaaaccacacagtaatacgaagtgcgaggaggcctcacattgcgggaagagacattataaatgttcagaatgtggaaagacatttagtaggaaggattcacttgtccagcatcagcgcgtgcataccggcgaaagaccgtacgagtgtggggaatgcggcaagactttttctcgcaaaccaatcctcgcccaacaccaacggattcataccggcgaaatgccttatgaatgtggtatctgtggtaaggtcttcaaccacagttcaaatctgattgtgcaccaaagggtgcatacaggtgctaggccctacaaatgttccgagtgtgggaaggcctacagtcacaagtctaccctggttcagcatgaatctattcacaccggtgaacggccttacgagtgcagtgagtgtgggaaatattttggacataaatatcggcttataaagcactggtccgtgcacacgggagcacgaccctacgagtgtatcgcatgtggaaagtttttttctcaatcctccgatctgattgctcatcagcgggtgcataatggggaaaagccttacgtgtgctccgaatgcggaaaggcgttcagccacaagcacgtcttggtccagcaccatcgcatccataccggtgagcggccatataaatgttctgaatgtggcaaggctttcaggcaacgcgcatctctgataaggcactggaagatccatacaggtgaacgcccttag

SEQ ID NO: 25830 - DNA, 735 bp, Artificial Sequence
  Description of Artificial Sequence: Synthetic coding sequence
atggccgcagcagaaccaatgggcccagcacagggccaggtcaactttgaagatgtgttcgtctatttctcacaggaggaatgggtgctgctggacgaggcccagcgcctgctgtatcgggacgtcatgttagagaacttcgcacttatggcctccctaggatgttggcacggtatggaggacgaggagattccttttgaacagtccttttcgatcggcatgagccaaatccgaatccccaagggcggaccctcaactcagaaagcttacccttgtggtacatgcggccttgttttgaaggatatactccatcttgcagaacatcaggaaacacaccccggtcagaagccctatatgtgcgttctatgcggtaagcaattctgtttctcagccaacctgcatcagcaccagaaacagcattcaggggagaaacctttcagatccgataagagtcgaccctttctgctgaacaactgtgctgtgcaatcaatggaaatgtccttcgtcacgggagaggcatgtaaggacttcttggccagctcctctattttcgagcaccacgcaccacataatgagtggaagccgcactctaatactaaatgtgaggaagcctctcactgtggaaagcggcactacaaatgctctgagtgcgaaaagacagccgcaaactatagggagtatgacccctccaagggaactagtacatgtgtgtcaattaccctggcacctttgtag

SEQ ID NO: 25831 - DNA, 1470 bp, Artificial Sequence
  Description of Artificial Sequence: Synthetic coding sequence
atggcagctgcggaaccgatgggccctgcccaagttccgatgaattccgaggtgatagttgaccccatacagggacaggttaattttgaggacgttttcgtgtacttctctcaggaggagtgggtgttgctcgacgaggcccaacgcctcctgtatagggacgtgatgctcgagaatttcgcgcttatggcctctctaggacatacatcatttatgagtcatatcgttgcctctctggtcatgggttctgagccttgggttcccgactgggtggacatgaccttggctgtggccacagagacgcccggaggctccgatccaggctgctggcatgggatggaggacgaagagataccctttgagcaatctttcagcataggcatgtctcagattcgcatcccaaaaggtggaccttctactcagaaggcctacccctgtggaacatgcggcctggtgcttaaggacatccttcatctggccgagcaccaggaaacacatcctgggcagaagccttatatgtgcgtgctgtgcggcaagcagttctgtttttccgcgaacttacatcagcaccaaaaacagcattcaggagagaagcctttccggtctgataaaagtagaccttttctcctcaacaattgtgcagttcagtctatggaaatgtcctttgtcacaggtgaggcatgcaaggactttctggcttccagctccattttcgaacaccacgctccgcacaacgagtggaagccccattctaatactaagtgtgaggaagcgtcacattgcggcaagaggcattataagtgttcagaatgcggtaagacattctctcgaaaggactcactggtccagcatcagcgcgtccacaccggggaacgaccatacgagtgtggcgagtgcggcaaaaccttttcccggaagccaatcctcgcccagcaccaacgaattcacaccggcgagatgccctatgagtgcggcatttgtggaaaggtgttcaatcacagtagtaacttaattgtgcaccagagggtgcataccggcgctcgcccatataagtgctctgaatgcgggaaggcctactcacacaagagcactctggtccagcacgagagcattcacaccggagaaagaccatacgagtgcagcgaatgcggcaaatattttgggcacaaataccgcctcataaagcattggtcagtgcacactggggctcgcccttatgagtgtatcgcttgcgggaagttctttagtcagagttccgaccttatagcccatcagagagttcacaacggggagaaaccgtatgtctgctctgagtgtggaaaggcttttagccataagcacgtcttggtacagcatcacaggatccatactggagagaggccatacaaatgtagtgaatgcggcaaagcttttcgccaaagggcaagcctgatccggcactggaagattcacactggggagagaccatag

SEQ ID NO: 25832 - DNA, 1347 bp, Artificial Sequence
  Description of Artificial Sequence: Synthetic coding sequence
atggccgctgccgagccgatgggacctgcccaggtacctatgaactctgaggtaatagttgatcctattcagggacaagtgaatttcgaggacgttttcgtatattttagtcaggaagaatgggtacttctggatgaggcccagcggctcttgtaccgggacgtgatgctggaaaattttgccttgatggccagtctgggctgttggcacggcatggaagacgaagaaatccctttcgaacagagcttttcaattgggatgtcccaaattagaattcctaaagggggaccctcaacccagaaggcttatccctgcgggacctgtggtctggtgctgaaagacattctgcatctagccgagcatcaggagacacatccaggtcagaagccctacatgtgcgtgctctgcggaaaacagttttgcttttccgccaacctgcatcagcaccagaagcagcactccggagaaaagcccttcaggagcgacaaaagtcgcccatttcttctgaacaactgcgcagtccagtctatggaaatgtccttcgttacgggggaagcttgcaaagacttccttgctagcagttcaatcttcgagcatcacgcccctcataatgagtggaagccgcactccaataccaaatgtgaggaggcatctcactgcggaaagcggcactataaatgttcagagtgcgggaagactttctcgcggaaagactctttggtccagcatcagagagtccacacgggcgagcgaccttacgaatgtggagaatgcggcaaaaccttttcacggaagcccatcctggctcaacaccagagaattcatactggagaaatgccctacgagtgcggcatctgtggaaaggtcttcaaccattctagcaacctgattgtgcatcaaagggttcacaccggcgctcgcccttataaatgctcagagtgcgggaaagcgtattcccacaagagcacactggttcagcatgagagtatccataccggtgaacgcccttacgaatgttcagagtgcggcaaatactttggccataagtatcgccttattaagcactggagcgtacatacgggggctcgaccttacgaatgtattgcgtgcggtaaattcttttcacagtcctccgatctaatcgcccatcaacgggtccacaacggcgagaaaccctatgtgtgttctgaatgtggcaaagccttctcccacaaacacgtactagtacagcatcacaggatccacaccggcgaaaggccttacaagtgtagcgagtgcggtaaggcctttcgccagcgagcatctttgataaggcactggaaaattcacaccggggagcgcccatag

SEQ ID NO: 25833 - DNA, 1134 bp, Artificial Sequence
  Description of Artificial Sequence: Synthetic coding sequence
atggaggacgaagaaattccgtttgaacagtcattttccatcgggatgtcgcagatccgtataccaaagggcggaccttcaacacagaaagcttacccatgtggcacctgtgggctggtgctgaaggatatattacacctcgccgaacatcaagagacccaccctgggcaaaagccctacatgtgtgtgctgtgcggcaagcagttttgtttctctgccaacctgcaccagcaccaaaagcaacactctggcgagaaacctttccgctctgacaaaagccgtccatttctgttgaacaattgtgctgtgcagtcgatggagatgtcgttcgtcaccggggaagcctgtaaggatttcttggcttcctcctcaatattcgagcatcacgctcctcataacgaatggaagcctcattcgaatacaaagtgcgaagaggcttctcactgtggcaaaaggcactacaaatgctccgaatgtggcaagaccttttcaaggaaggatagtctggtccagcatcaacgtgtccacaccggtgagcgtccctatgaatgcggagaatgtggcaaaacgttttctaggaagcccattctggcgcaacaccaacggattcatacgggtgaaatgccctacgagtgcggtatatgcggcaaagtgtttaaccactccagtaatcttattgtacaccaacgggtacataccggagcccgtccttacaagtgttccgagtgtgggaaggcctactcacacaagtccactctggtgcaacatgagtccatccacaccggggagcgcccatatgagtgcagtgaatgtggcaagtattttggtcacaagtacaggctcatcaaacattggtctgtgcatacaggtgcccgtccgtacgaatgcatagcctgtggaaagttcttctcacagtcgagtgatctgatcgcccaccagcgcgtgcacaatggcgaaaagccgtacgtttgtagtgaatgcggcaaagctttcagtcataaacacgtgcttgtacaacaccacagaatccacactggggagcgaccatacaagtgctccgagtgtgggaaagctttccgtcagcgcgctagtctgatcaggcactggaagatccacaccggcgagcgcccatag

SEQ ID NO: 25834 - DNA, 1329 bp, Artificial Sequence
  Description of Artificial Sequence: Synthetic coding sequence
atggctgccgcaacactccgcgatcctgcccagcagggatatgttactttcgaagacgttgctgtgtacttcagccaggaggagtggcggttactggacgatgcccaacgactcctataccgcaatgtcatgctggagaacttcacgctcttggccagccttggattagccagcagtaagacgcacgaaatcacccagctcgaaagctgggaagaaccatttatgcctgcgtgggaggtggtgacctccgccatactgcgtgggagttggcagggagcaaaggccgaagccgcagcagagcaatcagcctccgtcgaggttcctagctccaacgttcagcagcatcagaaacaacactgtggcgaaaagcctttgaaacgccaggaaggcagggtccctgtgctgcggtcatgtcgagtgcacttgtctgagaagtctctgcagagccgggaggtgggcaaggatttattgactagcagcggggttctcaagcaccaagtcactcacacgggagaaaaaagccataggagcagtaagtctagagaagcatttcatgccggtaagcgtcactacaagtgcagcgagtgtgggaaggcctttgggcagaagtacttgctggtacaacatcaaaggctgcatacaggcgaaaagccttacgaatgctctgagtgcggcaaactattttctcacaaatctaatctatttatacaccaaatcgtgcataccggcgaacggccatacggctgcagtgactgtggcaaaagtttttcacgaaacgccgacctgattcaacatcagagggtgcatactggcgaaaagcccttcacgtgttccgaatgcggaaaagcctttcggcacaactctaccctggtccaacatcataggatccatactggggttagaccctacgagtgctcagagtgcggcaagctctttagcttcaacagtagcttgatgaaacatcagagggtacacacaggagaacggccatacaagtgttccgagtgcggaaaattttattcacataagagctccctgataaatcactggagagtgcacactggagagcgcccatatgaatgttccgaatgcggcaagttctttagtcagtcgagctccctcatgcagcataggaaggttcacactggagagaagccatttaaatgtaatgaatgcggccgattcttctccgaaaattcaagcttggtcaagcaccagagggtgcacaccggagccaaaccctacgaatgtagggagtgcggtaaatttttcagacacagcagttctctcgtgaaacatcgtcgaatccacactggtgaaatccagtag

SEQ ID NO: 25835 - DNA, 423 bp, Artificial Sequence
  Description of Artificial Sequence: Synthetic coding sequence
ggtagcgtggcggcacctcgcgtggcacgtgcattgtctagcgtggtggtgagtccgcctcaggcacccatggccgcagccaccctgcgggaccccgctcagcagggctatgtaaccttcgaagacgtcgcggtctacttctcacaggaagaatggcgcctgttagacgatgctcaaaggcttctgtaccgaaatgtgatgctcgagaactttaccctactggctagtctcgggttggcaagcagcaaaactcacgaaataacacagttagagagctgggaggaacctttcatgccagcgtgggaagtggtaaccagcgctatcttgagggtgtggctgaggaacagatctgcaaatttgttaacacagatctttttcccgaaccgccagccgcaggttgctccagaacagggcagagaatag

SEQ ID NO: 25836 - DNA, 1452 bp, Artificial Sequence
  Description of Artificial Sequence: Synthetic coding sequence
atgtggctcggcacatctggcaagagtggtctgccgggacattgcctggaaaacccactacaggaatgccatccggcacagctcgaagaatgggccctgaagggcatttctcgcccttcggtgatctcccagcctgaacagaaggaagagccgtgggtgctgcccctccaaaacttcgaagctcgcaagattcccagggaatcccacacggactgtgaacatcaagtagcgaagctgaatcaggataacagcgagacggcagagcagtgcggcacaagcagcgagcgcactaacaaagacctctcccacaccctctcttgggggggtaattgggaacaggggcttgagctcgaggggcagcacgggactcttcctggagaggggcagctcgaaagcttctctcaggaaagagatttgaacaaactgctggatggctacgtgggggaaaaacctatgtgtgctgaatgcggcaaaagctttaaccagtctagttatcttattcgccacctgcgcacccacaccggggaaagaccatacacttgcatcgagtgcggcaagggtttcaagcaaagcagtgatctcgtcacacatagacgtactcatacaggtgagaaaccctatcagtgtaaggggtgcgagaaaaagttctctgattcctccaccctgattaaacaccaaaggacccataccggggagaggccgtacgagtgcccggaatgtggaaagacatttgggaggaagccccatctcataatgcaccaacgtactcacacaggagaaaagccctacgcctgcttagagtgccacaaatctttctccaggtccagcaatttcatcacccaccagcgtacacacacgggcgtcaagccctataggtgtaacgactgcggggagagtttttcacagagttcagaccttatcaaacaccagcgtacgcacacgggagagagaccattcaagtgtcccgagtgcggcaaggggtttagggattcgtcccactttgtggcccacatgtcgacccatagcggcgagaggcctttttcttgccctgactgtcacaaatcattctctcagtctagtcatctggtcactcaccagagaacgcatacaggtgagcggccatttaaatgcgaaaattgtgggaaggggtttgcagattcgagcgccctgatcaagcaccaacgaatacacaccggcgagagaccttacaagtgcggggagtgcggaaaatcctttaaccaatcttcccatttcattacccaccaacggattcacctgggcgaccgcccttaccggtgtccggaatgtggtaagacttttaaccaacgctcacacttccttacccaccagagaactcatacgggggagaagcctttccattgtagtaaatgtaataagagtttccgacagaaggctcatctgctatgccatcagaacactcatcttatttag

SEQ ID NO: 25837 - DNA, 240 bp, Artificial Sequence
  Description of Artificial Sequence: Synthetic coding sequence
atgtggttagggacatcaggaaagagtggcctgcccggacactgcttggagaatcccctgcaggaatgtcatcccgcacagctcgaggaatgggccctcaagggcatcagtaggccttcagtcatcagtcaaccagagcaaaaagaagagccctgggtgctgccgctgcagaattttgaagccaggaagatcccgagggaatcccacacagactgtgagcaccaggtggctaagttgtag

SEQ ID NO: 25838 - DNA, 1614 bp, Artificial Sequence
  Description of Artificial Sequence: Synthetic coding sequence
atggaaagcgggctggccggaaacggaaccggcgctggcctggtgatgaaggtgaaacaggaaaagccagaacgactgctgcagaccctggcccctcaagccatgctggtggaaaaagataaggagaatatctttcagcagcacagagggctcccacccagacagactatgggtaggcccagggcccttggcggacaggaggaaagtggctctccgagatgggctccaccaacagagcaagatgctggcctggctggtcgcgctcccggatcggcatcaggacccttgagcccgagcctctcaagtggggagggtcattttgtgtgccttgactgtggcaagcgcttttcctggtggagctccttaaaaatccaccagaggacccacaccggggagaagccctacctgtgcggtaaatgtggcaaaagcttctcccagaagcctaatcttgctagacatcagagacaccacaccggggagaggccattttgttgccctgaatgtgctcgtcgtttcagccagaaacagcacttactcaaacaccaaaaaacgcacagtcgtccagctacccactcctgtcctgaatgcgagaggtgtttccgccaccaggtcgggctcaggatccatcagagggcccacgcccgagatagacagggtagtcgggctggcttgcacgagctgattcaggacgccgctgcgaggcgcgcttgtcgactgcagccaggcccacctagaggaaggcctgaatgggcatggctaggcttatgtcagggatggtggggccaaccaggggcacgcgcagctgtcagcgggcctgaaggtccaggggaaccccgacaattcatttgtaatgagtgtggtaagagcttcacctggtggagcagcctgaatatacaccagcgaatccacactggagagcgcccatatgcttgtcccgagtgtgggaggcggttctcccaaaagccaaatctgacgagacacctgaggaaccataccggtgaacgcccacatccctgccctcattgcgggagaggattccggcagaagcagcatctcttgaagcatttaaggactcacctacctggggctcaggcagccccatgcccatcttgcggcaaatcctgccgaagcagagccgcactgcgtgcccaccagagagcccacgccgtggccgagcctgctgtccctgccggagaacctggggaccagccacaggctgaggcgatccctggtctcgctgcaagacccagaagcagccagcgcagccccggagcgagggacacactctggggacgcggacaggctgggctagctggcccaggggagcccaggcagttcatctgcaacgaatgcggaaaaagttttagttggtggagcgctctgactatacaccagagaatccataccggtgaaagaccctatccttgtcccgaatgcggtcgcagattctcccagaaacctaacctgacccggcacagacggaaccacaccggcgagcggccttacctctgccccgcttgtggcagaggattttcgcagaagcagcatcttctgaaacatcagcgcgtccaccgggctgcacccgcatgctcgcccaaagaagaggctagatag

SEQ ID NO: 25839 - DNA, 435 bp, Artificial Sequence
  Description of Artificial Sequence: Synthetic coding sequence
atggagagcggtctggctggcaacggaacaggggcaggtcttgtgatgaaggtgaagcaggagaagcccgagagactgctgcagacactggccccacaggcaatgttggtggagaaagataaggagaacatctttcaacagcatagaggtctgcccccaaggcaaactatgggcaggccaagagctctggggggacaggaggagtctggctcacctagatgggcccctcctactgaacaagatgctggactagctgggagagcgcctggttcggcgagcggcccactttcaccctcactgtcctcaggagagggacactttgtttgtctggattgcgggaagcgtttctcttggtggagctctctaaaaattcatcagcgcactcacactggcgaaaaaccctacctgtgcggcaagtgcgggaagagcttttag

SEQ ID NO: 25840 - DNA, 501 bp, Artificial Sequence
  Description of Artificial Sequence: Synthetic coding sequence
atggaaagcggtctcgcgggtaatggaactggggcaggacttgttatgaaggtaaagcaagagaaaccagagcgcctgttgcagactctggcacctcaggccatgctggttgaaaaagacaaagaaaacatctttcaacagcaccgcggactgcctccacgccaaactatgggaaggccacgtgctctcggtggccaggaggagagcggaagccccagatgggcacccccaaccgaacaggacgctggactggcaggccgtgcccctggatccgcttcaggcccattatccccatccctaagcagcggcgaaggacacttcgtgtgtttagattgcggcaagaggtttagctggtggagctcccttaagatccaccaacgaacacacacaggagagaagccatacttatgtggcaagtgcggcaagtccttttcccagaaacctaatcttgccagacatcagaggcatcacacaggagaaagacctttttgttgcccgtag

SEQ ID NO: 25841 - DNA, 1557 bp, Artificial Sequence
  Description of Artificial Sequence: Synthetic coding sequence
atggccgcagcagccctccgtcctccagctcagggaacggtgacatttgaggacgttgcagtgaacttcagccaagaagagtggagccttctcagcgaggctcagagatgcctgtaccacgacgtgatgctcgagaacttgacacttatctcttcactgggatgttggtacggggctaaagacgaaacgccaagtaaacagacgctgagtattcagcaggagtctcccctgagaacccactggaccggcgtgtgtaccaaaaaagtacatttgtggggaatgtgcggccctctcctgggggatattttgcatcaggggactcagcacaaccagaaactgaatgggttcggcgcttatgagaagaagctggatgacgacgcgaaccaccatcaggaccaaaaacagcatatcggggagaaatcttatcgcagcaacgccaaaggcacttcattcgtgaagaattgcaagttccatatgagccatgaaccctttatctttcacgaagttggcaaagacttcctcagctcacttcgtctcctccagcaggaagatatccatactagcggcaaaagcaacttcgagaccaagcacggcatcccactccagggcggtaagacacattacatctgcggagagtctactatccccttctccaataaacactccctggtccttcatcagagactgcttccacgagagggcccttatgtctgttcagactccgggaagttcacatcaaaatccaattcttttaataaccatcagggggttcgcaccggaaaacggccataccagtgtggtcagtgcgatgaatcgttttggtacaaagcacacttgaccgagcatcagcgtgtccatacaggggagcgaccctatgagtgtggcgagtgcgataaaagcttttctcacaaacatagtctggtagatcaccaacgtgttcacacgggggaacggccatatgagtgcgatgagtgcggaaagtccttctcacacaagaggagtctggtacatcatcagagagtgcatactggagagcgcccataccagtgcggggagtgcggcaagtcatttaaccacaagtgcaatcttatccaacaccagagggtccacacaggtgaacgcccatttgaatgcacagcctgtggcaaattattccgtagcaactcccacctaaaagaacaccagagagtgcatacaggtgagaggccctacgaatgcaaagaatgcagaaagtctttccgctacaagagccacctcaccgagcatcagagagtccacaccggggagcgaccctacgagtgcagggaatgtggtaaatgttttcatcaaaaaggttctctcatacaacatcaacagattcactccggcgaaagaccccatgaatgtggcgaatgcgggaaatgctttcaccagaagggtagcctgatcaggcaccagcaaatccattccggcgaacgcccacacgaatgtggcgagtgcggaaagtgtttccgccagaaagggaatctgattaagcatcaaagggtgcacaccggcgagagacaccatgagtgctag

SEQ ID NO: 25842 - DNA, 2064 bp, Artificial Sequence
  Description of Artificial Sequence: Synthetic coding sequence
atgctagaaaactatgagaatctcgcgtcggtcggacaccacttgtttcagcctagcgtgatttactggcttgaacaggaagaagagcttagggccggacgccgtgccgtgttacaggaatggaggctcaagacgaagggcccagccctacgtcaagatcgatcatggtttagggccagcaacgagacgcagacagcgagatcccacaatggaggtcaattgtgtgatagaacccagtgtggagaggccttttctgagcactcaggactgtctacccatgtgcggacacagaataccggagactcatgcgtaagcaatcactatgagcgcgacttcttcattccctgtcagaagaccctgtttaaaatcggcgaacagtttagcgtcctcggccagtgcggcaaggcgttcagcagcaccccaaatgtcgtgagtcagcaggcatgtactagggaccggtccctcgactacagctcctgcggagaggttttcctgaaccaatcatatctgcaggcgcgtgcagggagccacaacggcgaggagacatggaagtggaaaccctgtgggaaggctctaactcactccatgggctgtgcgactccagtcgagatgcatgctgtgcgcaatcctcatgtttgccgagaatgcggtaaagcattccgctacacggcctacctgacaggccgtgtacaggtgcaccccggtgaaaaaccttgcgagttggaagagtgcgggaaggcatcacctgtgagctcaagcctgacacagcacgtgcgtattcacgcagccgagaagccctgtgaatgtaaagaatgtggcaaggcattcaccggacttagcgggttgtccaaacatgtgcagaccgatcctggccagaaaccttatgaatgcaaagactgtgggaaagcctgcggaggattttacctcctcaacgagcatggaaaaacacatactcgagagaagccttttgcttgcgtggtctgcggcaaatattttagaaacagcagctgtctcaataaccatgtgcgaattcatacaggcattaaaccctacacttgctcctattgtgggaaagcattcactgtccggtgtgggttgacaagacacgttcggacgcatactggagagaagccatacacttgcaaggactgcggtaaagctttttgcacctcaagcggtcttaccgagcacgtacggacgcatactggggaaaagccctatgagtgcaaggattgtggcaagtcgtttacagtgagtagcagccttaccgagcatgcacggattcatacaggggagaaaccatacgagtgcaagcaatgtggaaaagccttcactggaagaagtggcctcaccaaacatatgcggacacatacgggagagaagccttacgaatgtaaggattgtggcaaagcttacaaccgggtgtatctgctgaatgagcatgtgaaaacacatactgaggaaaagccattcatctgcacggtgtgcagaaagagcttcagaaattctagttgcctgaacaaacacatacagatccacacgggaatcaaaccgtatgaatgcaaggactgtgggaaaacatttacggtgagctcgtcgttgacagagcatataaggacccataccggagagaaaccatacgagtgtaaagtctgcgggaaagcctttactacttcttctcacctcattgtgcacatacggacccatacgggcgagaagccctacatctgcaaggagtgtggaaaggcttttgcttcgtctagccacttaatcgagcataggagaacccacactggcgaaaaaccctatatttgtaatgagtgcggtaaggcctttcgggctagttcacacttgcataagcacggacggatccataccgggcaaaagccttacaaatgtaaggagtgcgggaaggcctacaatcgattctatctcctgaaggaacatctgaagacctataccgaggagcaggttttcgtgtgcaaggactgcggcaagtcttttaagaattccagctgtctgaaccatcacacccagatccacaccgacgagaagccattctag

SEQ ID NO: 25843 - DNA, 2190 bp, Artificial Sequence
  Description of Artificial Sequence: Synthetic coding sequence
atggctgcccctgatttggctcatggtggccacgtgtccagagactcagtctgcctgcatgaggaacagacccaggctgctggaatggttgcagggtggctcatcaattgctaccaggatgcggtgacttttgacgatgtggcggttgactttacacaggaggagtggaccctcctggatccatcccagagggatctttatagagatgttatgctagagaattatgaaaatctcgcatcagtcgagtggcggctcaagacaaagggaccagctctaagacaggataggtcttggttcagggcctctaacgagacccagaccgcacggagtcacaacggcggacaactttgcgaccgcacccagtgcggggaagcttttagcgaacattccgggctctcgacacacgtgcggacacagaacacgggtgattcctgtgtatccaatcactacgaacgcgacttttttatcccatgtcaaaagaccttattcaagattggcgagcaatttagtgtcctcggtcagtgcggtaaggcttttagcagtacacctaacgttgtttctcaacaggcatgcacccgggacaggtctttggactatagcagctgcggtgaggtgttcctgaatcagtcctacttacaagcaagggccggaagtcataatggggaggagacttggaagtggaaaccatgcggcaaggcattgacccatagtatggggtgtgccactcccgtagaaatgcatgccgtacgcaatcctcacgtttgtcgggagtgtgggaaagcctttagatacaccgcgtacctaacgggcagggtgcaggtgcatcctggtgagaagccatgcgagctggaggagtgtggcaaggctagccctgtgagctccagcctgacgcagcacgtgcgcatacacgccgctgagaagccctgcgaatgcaaggagtgcgggaaggcgttcactggactatccggtctgtccaagcacgtccaaactgatccgggtcagaagccttatgaatgtaaagactgtggaaaggcttgtggtggcttctacctgctgaacgagcatggcaagacacatacacgggagaagccatttgcctgcgttgtgtgcggtaaatactttcgtaatagctcatgcctcaataatcatgtgaggatccacactggtatcaaaccatacacctgtagttattgcggtaaagcctttaccgtgcgctgtgggctaacccgtcacgttcggactcatactggagagaaaccctatacatgcaaagactgtgggaaggcattttgtacaagttctgggctgacagagcacgtgcggacccacacaggggaaaaaccttacgaatgcaaagattgcggcaagtcctttactgtcagtagcagtctcaccgaacacgctaggatccacaccggggaaaagccttacgagtgtaaacaatgtggcaaagcgttcactggtagaagcgggctcacaaaacacatgcgaacccataccggggaaaagccatacgaatgtaaagattgcggaaaggcgtacaacagggtttacctcctgaatgagcacgtgaaaactcacacagaggagaagccatttatctgtaccgtgtgccgcaaatcgttccgcaatagcagttgcctgaataagcacattcaaatccatactgggattaagccctatgaatgcaaagattgcggtaagacgttcacagtgtcgagtagtctgacagaacatattagaactcacaccggtgaaaaaccatatgagtgtaaggtgtgcggaaaggcttttacaactagctctcatttgattgtgcatatcagaacccataccggggaaaagccatacatctgcaaagagtgcgggaaggcctttgcctcatctagtcatctgattgagcacaggcgtacacacaccggggaaaagccatatatatgtaacgaatgtggaaaagctttccgggcttcttcccatttgcataagcatgggagaattcacaccggtcagaagccctacaaatgcaaagagtgtgggaaagcctacaaccgattttacttattgaaggagcatcttaaaacctacaccgaggaacaagtattcgtgtgtaaggactgcggaaagtcattcaagaattcatcatgcctcaatcatcacacccagatacatacagatgagaagccattctag

SEQ ID NO: 25844 - DNA, 1926 bp, Artificial Sequence
  Description of Artificial Sequence: Synthetic coding sequence
atggtgcatgggagtgtaacttttagagatgttgctattgatttttcacaggaagagtgggagtgcctccaaccagaccagcggaccctgtatagggacgttatgttggagaactatagtcatctgatcagcctagggagcagcatctcaaaacccgacgttatcaccttactcgagcaggaaaaggaaccttggatggttgtgcgcaaggagacttccaggcgataccccgatctcgagttaaagtacggccctgagaaggtgagccctgaaaatgacacctccgaggtgaacctgccgaaacaggtgattaaacagatttccacgaccctgggaatcgaagccttttactttaggaacgatagtgagtatcgacagttcgagggccttcaaggatatcaggagggaaacattaaccagaagatgatatcctatgagaagctgccgacacatacacctcatgccagccttatttgcaatacccataagccatatgagtgtaaggagtgcggcaagtatttttcacggtctgccaaccttatacagcaccagagtatccacacgggcgagaaacccttcgagtgtaaagagtgtggcaaagccttccggttgcatattcagtttactagacatcagaaattccacaccggagaaaagcctttcgagtgtaatgagtgcggaaaagcatttagtttgttaactctgttgaataggcacaagaacatccacaccggcgaaaagcttttcgagtgtaaggaatgtggtaagtcctttaatcgttcctccaacttggtgcagcaccagagcatccactccggagttaagccctatgaatgcaaagaatgtgggaaggggttcaaccggggagcccatctgattcaacatcagaagattcacagtaatgagaaaccgtttgtgtgcaaggagtgtggaatggcctttaggtaccattaccagctgatcgaacattgccagatccacacaggtgaaaaacccttcgagtgcaaagaatgcggcaaggcgtttaccttattgactaagctggtccgccaccagaaaattcacacaggggagaagccatttgagtgtcgcgagtgtggcaaagcattttctctcctgaatcagcttaaccgccacaaaaatattcacaccggcgaaaaacccttcgagtgtaaagagtgcggcaagtcttttaatagaagcagcaacctggtccagcatcagtccatccacgctggcatcaaaccctacgagtgtaaggaatgcggtaaaggctttaaccggggtgcacatttaattcagcatcaaaagatccattcaaatgagaagcctttcgtctgtcgagaatgtgaaatggcattccggtatcactgccagttgatagagcattccaggatacatacaggagataagccatttgagtgccaggactgtggtaaagcatttaataggggctcctccttagtccagcaccaatccattcatactggggagaagccttatgaatgcaaagaatgtggaaaggcctttcggttgtaccttcagctgtcgcagcatcagaaaacccatactggagagaagcctttcgagtgtaaagagtgcggaaaattctttcgacgtggcagtaacctgaatcagcatagatctattcatactgggaagaagccattcgagtgtaaggaatgcggcaaagccttcagactgcatatgcatctcatccgccaccagaagttgcacactggcgaaaagccttttgagtgtaaggaatgtgggaaggctttccgactccacatgcagctgattcggcaccaaaagctccacaccggcgaaaagccctttgagtgtaaagagtgtggcaaggtattttcattaccgacgcagttaaatcgccacaaaaacatccacactggagaaaaggcaagttag

SEQ ID NO: 25845 - DNA, 477 bp, Artificial Sequence
  Description of Artificial Sequence: Synthetic coding sequence
atgggcagaagtccaagaaaaatagaccaattctgtaactcctccaatatggtgcatgggagcgtcacttttagggacgttgctattgatttttcacaggaggaatgggaatgtctgcagccagatcaaaggaccctttaccgggacgtgatgctggaaaactattcacacttgatctccttgggctcctccatatcaaagccagatgtgatcacattgcttgagcaagagaaggagccctggatggttgtgcggaaagaaacatcccgacgctaccctgacctggagcttaagtacggacccgagaaagtaagtcccgagaacgacacatctgaggtgaatctccccaaacagattagctcactcgcatctaaaccaagctttacagccatacacattcaaagaagaatacattgtcggatctgtatcgccttcggctatctaagtttagtgtattgttcattggaaatcctgtag

SEQ ID NO: 25846 - DNA, 348 bp, Artificial Sequence
  Description of Artificial Sequence: Synthetic coding sequence
atggtgcatggtagcgtcaccttccgtgacgttgcaatcgacttctcgcaggaagaatgggagtgtcttcaaccggaccagcggactctttatcgcgacgtcatgttagaaaactatagccacctgatctccctcggatctagcatctcaaagcctgacgtaatcaccctgttggaacaggagaaggagccctggatggtcgttcggaaagagacctctcggaggtacccggacctggaactaaagtacggcccagagaaggtaagtcctgagaacgacacgtcagaggtcaatttacccaagcaagtgatcaaacaaaaaaaggggaagaagaagaaaaaaaagtag

SEQ ID NO: 25847 - DNA, 1926 bp, Artificial Sequence
  Description of Artificial Sequence: Synthetic coding sequence
atggttcacgggtcggtaaccttccgagacgtggctattgacttcagccaggaagagtgggagtgcctgcaaccagatcaaaggacactgtaccgtgatgtgatgctggaaaactactcccacttgatatctttaggtagcagtatcagtaagcccgacgtgattacacttttggaacaggaaaaggaaccatggatggttgtaagaaaggagacatcccggagatacccagatctcgaacttaagtatggcccagaaaaagtgtcgcctgagaacgatacatcggaagtgaatctacctaaacaggttataaaacagatttcaactacgcttggaattgaagctttttacttcaggaatgattctgaatatcggcagtttgaggggctgcagggataccaggagggaaacatcaaccaaaaaatgatcagttacgagaaacttccgactcataccccacatgccagcctaatctgcaacacccataagccatatgaatgcaaagagtgcggaaagtacttcagcagatcagccaacttgatccagcaccaatcaattcatactggcgagaagccatttgaatgtaaggagtgtggaaaggccttccggctacacattcagttcacacgccatcagaaattccatacaggtgaaaaaccgttcgaatgcaatgagtgcggcaaggctttctctctgctaactctgcttaacaggcacaagaatatccacaccggtgaaaagctgttcgaatgcaaagaatgtgggaaatccttcaaccggagctcaaacctcgtgcagcatcagagcatacactccggggtcaaaccctacgagtgcaaagagtgcggcaaaggcttcaaccgcggagcccatctgattcagcatcagaaaatccattctaacgaaaaacctttcgtctgcaaggagtgcggcatggccttcagataccactatcaactgatagaacactgccagattcacacgggtgagaaacctttcgagtgtaaggagtgtggcaaagcattcactctgctgaccaagttagtgagacaccagaagatccacacgggagagaaaccctttgagtgcagagaatgcggaaaggcattctccctgctgaatcaactcaatcgacacaaaaacatccacactggagagaagcccttcgaatgtaaggagtgtggaaaaagctttaacaggagctccaatctggttcaacaccagagcattcatgcgggtataaaaccctatgagtgtaaggagtgcggaaaaggctttaaccggggagcccacctcatccagcaccaaaaaatccacagtaacgagaaaccatttgtgtgccgggaatgcgaaatggcatttcgttaccactgccagttaattgagcactcacgaatccatacaggtgacaagccttttgagtgtcaggactgtggaaaagccttcaataggggatccagtcttgtccagcaccagtctatccacacaggcgagaagccctatgagtgtaaagaatgcgggaaagccttccgtttatatcttcagctgagccagcaccagaagacacacacaggcgagaaacccttcgagtgtaaggaatgcggcaaattttttcggcgaggtagcaacctgaaccagcacaggagcattcacaccggaaagaagccattcgagtgcaaagagtgtgggaaagcgttccggcttcatatgcatctgattcgccatcagaagctccacaccggagagaaaccatttgaatgtaaagaatgtggtaaagcattcagactccacatgcaactcatccgccaccagaaactgcacactggggaaaaaccattcgaatgcaaggaatgcggaaaagtcttcagtcttcccacccagctgaatagacataaaaatatccatactggcgagaaggcatcctag

SEQ ID NO: 25848 - DNA, 1929 bp, Artificial Sequence
  Description of Artificial Sequence: Synthetic coding sequence
atggtccacggaagcgtcacctttcgcgacgtggccattgacttttcgcaagaagagtgggagtgtctccagccagaccaacgaacgctctacagagatgttatgctggaaaactactcacaccttatcagcctggccggtagcagcattagcaagcccgacgtgattacacttctcgaacaggagaaggagccctggatggtggtgcgcaaggaaacaagtaggcgttacccggacctggagctcaagtacggccctgaaaaggtgagccctgagaacgatacatccgaagttaatttgcctaaacaggtgataaagcagatctccaccaccttgggtatagaggctttttattttcggaacgatagcgaatatagacaatttgaagggctgcagggctaccaagaaggtaatatcaaccagaagatgatttcctatgagaaattacccactcacactccccacgctagtctcatatgtaatacccataagccatacgaatgtaaagagtgtgggaagtatttttcaaggagcgcgaatttaatccagcaccagtcaatccataccggcgaaaaacctttcgagtgtaaggaatgcggaaaggctttcaggcttcatatccagtttacgcgccatcagaaatttcacacaggggaaaaacccttcgaatgtaacgaatgtgggaaagccttcagccttttgaccctcctgaaccgacacaagaatatccacacaggagagaaacttttcgaatgcaaggagtgtggcaagtcatttaacaggagctccaacctggtgcaacatcagagcatccactccggggtgaagccttacgagtgcaaggagtgtggcaaggggtttaatcggggtgctcatctaatccaacatcagaaaatccacagcaacgagaagcccttcgtctgcaaggaatgcggtatggccttccgttaccactaccagctgatcgagcactgccagatacacactggcgagaagccttttgagtgcaaggagtgcggtaaggccttcaccctcctcaccaagttagtgaggcaccagaaaatccatactggggagaagcctttcgaatgtcgcgaatgcggcaaagcgttctccctccttaatcaacttaatcgccacaagaacatccatacaggcgagaagccgttcgaatgtaaagaatgtgggaagagtttcaacagatccagcaacttggtccaacatcagtcaatccacgcgggaataaaaccttacgagtgtaaagagtgcggtaaagggtttaatagaggcgcacatctgattcagcatcagaaaattcactctaacgaaaagcccttcgtgtgtcgtgaatgcgagatggcatttcggtaccactgccagctcatcgagcactcacgaatccacaccggggacaaaccttttgagtgtcaggactgcgggaaagcattcaatcgcggttcttcccttgttcagcatcagagcattcacacaggagagaagccatacgaatgcaaagaatgcggtaaagccttccggctttacttgcagttaagtcaacatcagaagacacataccggcgagaaaccttttgagtgtaaagagtgtgggaaattctttcgtaggggcagcaaccttaaccagcatcgctccatacatactgggaagaagccgttcgaatgcaaagagtgcggtaaggccttccggttgcatatgcatcttattcggcatcaaaaactgcacacaggggaaaagccttttgaatgtaaagagtgcgggaaagccttcagattacatatgcaacttattcgtcatcaaaaattgcataccggggaaaagccttttgaatgcaaggagtgcggtaaggtgtttagccttcccactcaattgaatcgccacaaaaatatccacacaggagaaaaagcttcctag

SEQ ID NO: 25849 - DNA, 1926 bp, Artificial Sequence
  Description of Artificial Sequence: Synthetic coding sequence
atggtgcatgggagtgttaccttccgcgatgtggcgatcgatttttcacaggaagagtgggaatgtctgcagccggatcaaagaaccctgtatcgtgacgttatgctggagaactattctcacctgatatctctcggatcttcaatctctaaacctgacgtgataactctgcttgagcaagaaaaagagccctggatggtggtccgcaaggaaacctcacgtagatatcctgaccttgaactcaagtacggtcccgagaaagtctccccagaaaatgataccagtgaagtgaatttacctaagcaagttataaaacagatctccactaccctggggattgaagctttttatttccgaaatgacagtgagtatcgccagtttgagggtctccagggctaccaggaagggaatatcaaccagaaaatgataagctatgaaaagctgcctacccatacaccacatgcaagtctgatatgcaacactcacaaaccttatgaatgtaaagaatgtgggaaatactttagtaggtccgcgaatctcatccagcaccagagtatacatacgggtgagaagccgttcgaatgcaaggagtgcggtaaggccttccggctccatatccagttcactaggcaccagaagttccacacaggtgaaaagccgtttgaatgtaacgagtgcggtaaagcattttctttactgactctgctgaatcggcacaaaaatatccacacaggggaaaagttattcgaatgcaaggagtgtggcaagagcttcaatcgatcttcaaacctagtgcagcaccagtctatccacagcggagtgaaaccttatgagtgcaaagagtgcggcaagggattcaacagaggggctcacctcatacaacatcagaagatccactcgaacgagaagccttttgtgtgcaaagagtgcgggatggcattccggtatcattaccaactgatcgaacattgtcaaatccacaccggcgaaaagcccttcgaatgcaaggagtgtggcaaagccttcaccctgctgacaaagctagtgcgacatcaaaagatccacactggagaaaaaccttttgaatgcagagagtgcggtaaggcgtttagtctattgaaccagctgaacaggcataagaacatacacactggcgaaaagccgtttgaatgcaaagaatgcggcaaaagtttcaataggtcttccaatctagtgcagcatcagagcatacacgctggtattaagccctatgagtgcaaagaatgtgggaagggtttcaataggggcgcacatcttattcagcaccagaaaatccattccaacgagaagccatttgtgtgtcgagaatgcgaaatggccttccgttaccattgccagctcatcgaacactcacgaatacacacgggagacaaaccatttgaatgccaggattgtggcaaggcatttaatagggggtcctctcttgtacaacaccaaagtatccataccggagaaaaaccatacgagtgcaaggaatgtgggaaggcttttcggctgtacctgcagttgtctcagcatcagaaaactcatactggcgaaaagccatttgagtgtaaagaatgcggcaaattttttagaagagggagcaatttgaaccagcaccgatccattcacaccggaaagaaacccttcgagtgcaaggagtgtggtaaagctttcaggctccatatgcatctaatcaggcaccagaagctgcacacaggagagaaaccttttgagtgtaaggagtgcggcaaggccttccggctacatatgcagctgatccggcatcagaaactccacactggagaaaagcccttcgagtgtaaggagtgtggcaaagttttctctctgcccacacaattaaatagacacaagaatatccataccggtgagaaggccagttag

SEQ ID NO: 25850 - DNA, 16217 bp, Artificial Sequence
  Description of Artificial Sequence: Synthetic coding sequence
atgggagccctctggtcctggtggatcttgtgggctggtgctacccttctgtggggccttacccaggaagcctccgtagatctcaagaacacggggcgagaagagtttttaactgcatttctgcaaaactaccaactggcatacagtaaggcataccctcggctattgatatctagcctgtcagaatcccctgctagtgtgagcattctgtctcaggccgacaacacaagcaagaaagtgacagttcgccctggggaaagtgtaatggtaaacattagcgccaaggctgagatgatcggctctaaaatcttccagcacgccgtggtcatccactccgattacgcgattagtgtgcaagcactcaatgcaaaaccagatacggcggaactaaccctactgaggcctatccaggcccttgggaccgaatactttgtgctgactcctcccggtactagtgcgagaaacgtcaaagaatttgcagttgtagccggagcagccggtgccagcgtcagcgtgacactcaaaggctcggtgacatttaatggaaaattttaccctgctggggacgtcttgcgagtgactctgcagccctacaatgtggctcagctacagagcagtgtagaccttagcggcagcaaagttacagccagctcccctgtagccgtgttgagcggacatagttgcgcccagaagcacacaacctgcaatcatgtcgtagagcagctgctgcctacctctgcctggggcacgcactatgtggtcccaaccttggcttcacagtcgcggtacgaccttgctttcgtggtcgcttcacaggccactaagctgacctacaaccacggcggtattactggcagccgagggctgcaggcaggagacgtggtggagtttgaggtgcggccatcatggcctctgtacttatctgcaaatgtaggcattcaggtcttgttgttcgggaccggggcaattcgaaacgaggtcacctacgatccgtacttggtcctgatacctgacgtggccgcttactgccctgcgtacgtggtgaaaagcgttcccggatgcgagggcgtagcgctcgtcgtggcccagaccaaagcgatttctggtcttactatcgatggacacgctgtgggggcaaagctgacttgggaagcagtcccgggaagtgagttttcttacgccgaggtcgaactggggacagcagatatgattcacacagcagaagctaccacaaacttgggcttgctgaccttcggcctggcaaaagcgattggatatgcaacggccgctgactgcgggaggaccgtgcttagccctgtcgaacccagttgcgagggcatgcagtgtgccgctggtcagcgctgtcaagtggtgggcggaaaagccggttgcgtggccgagtccacggcggtctgccgtgctcagggagatccacattacacaactttcgacgggaggagatatgatatgatgggaacctgctcatacacaatggttgagttgtgtagcgaggacgacacactacccgctttttcagtcgaagccaagaacgagcaccgaggctccagaagagtgtcctatgtggggttggtgactgtgcgggcttattctcatagtgtgagtcttaccaggggcgaggtggggttcgtgctggttgataaccagcggtcacgtctgcccgtaagcctgagcgaaggaaggctgcgtgtgtatcagtctggtccgcgagcagttgtcgagttagtctttggcttggtggtaacatacgactgggactgtcaacttgcactgtcgctccctgccagatttcaagaccaggtctgcgggctctgtggcaattacaatggggaccccgctgacgacttcctgactcccgacggggcactggcccctgacgcagtggagttcgcctccagctggaaactggacgacggagattacctctgcgaggacgggtgccagaacaactgtcccgcatgcaccccaggccaggcccagcactatgagggcgaccgcctctgtggcatgcttacaaagctcgacgggccattcgccgtttgccacgatacactggacccccgaccattcctcgagcagtgtgtgtacgatctgtgcgttgtgggaggagagcggctgtctctctgtcggggtttgtctgcctacgctcaagcctgtctggaattgggcataagcgtcggagactggcggtcccctgccaattgccctctttcctgcccagccaactcaagatacgagctgtgcggcccagcatgtcctacctcgtgcaacggggctgctgctcccagcaattgcagtggcagaccgtgtgtagaaggctgtgtgtgtctccccggtttcgtggccagcggaggtgcttgtgtccctgcgtcgagctgtggctgcactttccaagggctccaactcgcacctggccaagaggtgtgggccgacgaactgtgccagcgcagatgcacttgtaatggcgctacgcatcaagtcacctgtagagacaagcagagctgtccggcaggggaacgctgttcagttcagaacggactgcttggctgctatccagaccgctttggcacatgtcaggggtcaggagatccccactatgtgagtttcgatggaaggcgctttgatttcatgggcacatgtacctatctcctggtcggttcttgtgggcaaaacgccgcactgccagccttcagagttctggtggagaacgaacacaggggtagccagacggtatcctacacaagagctgtccgggtagaggcccgaggtgtgaaagtcgcagtgaggagagagtaccccggacaggtgctggttgatgatgtgctacagtatctaccatttcaagctgctgatggacaggtacaggtcttcaggcagggcagagacgccgttgtgaggacagattttggactaaccgtgacctatgattggaatgctcgggtcacggccaaagtgccaagctcatacgcagaagctctgtgtgggttgtgtggcaattttaatggcgatccagctgacgacttggccctccgcggaggaggacaggctgctaacgccctcgccttcggaaatagttggcaagaagaaactagacctggttgcggtgccactgagcccggagactgccccaagttagactccctcgtcgcacagcagctgcagtccaaaaacgaatgtgggatactggccgacccgaaggggccattcagggagtgccattccaaattggatccccagggggctgtaagggactgtgtctacgaccgatgtttactgccaggccagtcaggtcccctttgtgacgctctggcaacttacgcggctgcctgccaagccgcaggagccacggttcacccgtggaggtcagaagaactttgtcctctgtcttgtcctccacattctcactacgaagcctgctcttacggatgtccacttagctgcggtgacctgcccgtcccaggaggctgtggctcagagtgccatgaggggtgcgtctgcgatgaagggttcgcgctgtcaggcgaaagctgcctgccactggcatcctgtggctgcgttcatcagggcacttatcaccctccaggccaaactttttatcctggaccgggatgtgacagcctctgtcactgccaggagggagggcttgtgtcctgcgagagtagtagctgtgggccacacgaagcctgtcagcctagcggcggatccctgggttgcgtggctgttggatcttccacctgtcaagcttccggagatcctcactacactacctttgacgggcgacgattcgacttcatgggcacctgcgtgtacgtgctagctcaaacatgtgggactagacccggtttgcatcggttcgcggtcctccaggagaacgtggcctgggggaatggcagagtgtccgtaactagggtgatcacggtccaggtggcaaatttcaccctccgcctggaacagaggcagtggaaggttaccgtgaacggcgttgacatgaaacttcctgtggttctcgcaaatgggcaaatccgtgcttcgcaacacggcagtgatgtggtgatagagacagacttcggtttgcgggtggcctacgatctggtgtactacgtgcgagtgactgtccctggcaattactatcaacaaatgtgtggactttgcggcaactataacggagatccaaaagacgactttcagaaaccaaacggctcccaggctgggaacgccaacgaatttgggaatagctgggaggaggtggtacccgatagcccttgtttacccccaaccccctgccccccaggaagtgaggattgtattccgagtcataaatgtcctcccgaacttgagaagaagtaccagaaagaagagttttgcggcctactgtcttcccccacaggacctctcagcagttgccacaagctcgttgatccacaaggccctctgaaagattgcatattcgacctttgtctgggcggaggcaatctttcgatcctctgtagtaacatccatgcgtacgtttccgcgtgtcaagcagcgggaggtcacgttgagccctggcgcaccgagaccttttgccctatggagtgtcccccaaatagccactatgagctctgcgccgatacttgctcactaggctgctcagccctgagcgctcctccccagtgtcaggacggctgtgctgaaggttgccagtgtgattcaggtttcctctacaacggacaggcctgtgtgcccatccagcagtgtggctgttatcacaatggtgtgtattacgagcccgagcagacggtgctcatcgacaattgtcgacagcagtgcacctgtcacgctgggaagggaatggtctgccaggagcacagctgcaagccagggcaggtttgccagcccagtggaggcatactctcatgtgtcactaaggacccttgtcacggggtgacctgcagaccacaggaaacatgcaaggagcagggaggccagggcgtttgcctccctaactacgaggccacatgctggctgtggggtgacccccactaccattcgtttgatgggaggaagtttgattttcagggtacttgtaattacgtcctggccacgacgggctgtccaggagtatctactcagggactcacacctttcacagtgactacaaagaaccaaaatcgtgggaaccctgctgtttcttatgtgcgggtggttaccgtggctgccctcgggactaatattagtatccacaaggatgaaatcggaaaggtgagagttaacggcgtgttaacagccctgccagtgtccgtggccgacggtcgaatctctgtcactcagggagccagcaaagcactcctcgtggccgatttcgggctccaagtcagttacgactggaattggagggtggacgtgaccctgcccagttcctaccacggtgctgtttgcggcttatgcggcaatatggatcgcaatcctaataacgatcaggtctttccgaacggcaccctagcacccagcataccgatctgggggggaagttggcgggcacccggttgggatcccctttgctgggacgagtgtcgcggatcatgtcccacgtgtccagaggacaggctcgagcaatacgagggccctggattctgcgggccactagctcccggaacagggggtccttttacaacatgccatgcgcacgtgccccctgagtctttttttaaaggctgcgtcttggatgtttgcatgggcggaggcgaccgcgacatactctgtaaagcgcttgccagctacgttgcagcttgccaggctgctggggtggtcatcgaagattggcgagcccaagtggggtgcgaaatcacatgccccgaaaacagtcactacgaggtatgcggttcaccgtgtcctgcctcctgcccttcgcctgcccctttaaccactcctgcagtgtgtgagggcccttgcgtagaaggttgtcagtgcgatgccggattcgtcctgagcgctgatcgctgcgtccctctcaataacggatgtgggtgctgggctaacggtacttaccacgaagccggatctgaattttgggcggatggcacctgctcacaatggtgtcgctgcgggcctggtggaggatcactcgtatgcacgcctgcctcctgtggtcttggcgaagtttgcgggctcttgccttcgggacagcacggatgtcaacccgttagtaccgccgagtgtcaggcatggggggatccccattacgtgacactggatggccaccgattcaactttcagggcacctgcgaatacttactgagtgcaccatgccacggccctcctctgggcgcagaaaatttcaccgttaccgttgcaaacgagcataggggctcacaggccgtgtcatacactcggtctgtgacacttcagatttacaatcacagcttgactctctccgcccgttggcctaggaagctgcaggtcgacggtgtcttcgtcaccctgccattccagctcgattccttactgcacgctcacctgagtggggcagatgtcgtggtgacgaccacctccggcttaagcttggccttcgatggggacagctttgtcagattacgcgtccccgctgcttacgcaggctccctgtgcgggctctgcggcaattataatcaggatcccgcagatgatcttaaggccgttggcggaaaacctgctggatggcaggtcggaggggctcagggatgcggagaatgtgtgtcaaaaccgtgcccctcaccgtgtacgccagaacagcaggaatctttcggcggacccgatgcctgtggagtgatatcagccaccgacggtcctctagcaccgtgccacggtttggttccacccgcacagtacttccagggatgcctgctcgatgcatgccaggtccagggccaccccggaggtctgtgtccggcagttgctacgtacgtcgccgcatgtcaggccgctggagctcaactacgcgaatggaggcggccagacttctgccccttccaatgccctgctcactctcactatgaactatgtggggacagctgtccgggatcctgcccctctctatctgcacctgaaggatgcgagagcgcttgccgagagggttgcgtttgtgacgccggatttgtgttgtccggggatacgtgtgtgccagtgggtcagtgcggctgtcttcatgatgatcgttactaccccctgggacagaccttttatccgggacccggatgcgacagcctgtgcaggtgccgcgagggtggagaggtttcctgtgaaccctcctcctgcgggcctcacgagacatgtcgaccatctggaggttcactcggatgcgtggccgttgggagcaccacctgtcaggcatcaggcgatccacactatactaccttcgacggcaggcggtttgactttatgggcacgtgtgtctatgtgctcgcacagacatgtggaacaagacccggactccacaggtttgccgttctccaagaaaacgttgcctggggaaacgggagagtgtctgtgaccagagtgattactgtgcaggtggctaacttcaccttaaggctagagcaacgccaatggaaggtcaccgtcaacggagttgacatgaagctgccagtcgtgctggccaatggacagatcagagcatctcagcacggcagcgacgtcgtaattgaaacagattttggactgcgggttgcgtatgatctggtttactacgtacgcgtgaccgtgccgggtaactactaccaactgatgtgtggactttgcggcaactataatggggatcccaaagatgacttccagaaacccaatggaagtcaggccggtaacgccaatgagtttggcaattcctgggaggaggtcgttcccgacagtccttgtctgcccccaccaacctgtcccccaggtagtgaaggctgtataccctccgaagagtgcccccctgagttggaaaagaagtatcagaaggaggagttctgcgggctcctttcaagcccaaccggaccactttcttcctgccataaattagtcgacccacaggggccactgaaagactgcatctttgatctctgccttgggggaggcaacctgagtattctgtgcagtaacatccacgcttacgtgagcgcatgccaggcagctggaggccaggtggaaccatggcgcaatgagaccttttgtcccatggaatgtcctcagaacagccactacgagctttgcgctgatacatgctcgctggggtgcagtgccctgagtgcgcctctccaatgtccagatggctgcgcagaggggtgccagtgtgacagcgggttcctctacaatggacaagcctgcgtgccaatccaacagtgtggttgttatcataacggcgcttattatgagcctgagcagactgtcctcattgacaattgccgccagcagtgcacgtgtcacgtcgggaaggtggtggtgtgtcaagagcactcctgcaagccaggacaagtatgtcaaccttcggggggaatcttgtcttgcgtgaataaggacccatgtcatggagtcacttgtagaccacaggagacgtgcaaggagcagggcggtcagggtgtttgtctaccgaattatgaagcaacatgttggctgtggggtgaccctcactaccattccttcgatgggagaaagttcgactttcagggtacgtgcaattatgtgctggccacaacagggtgtccgggtgtgtccacccagggtctaacaccctttaccgtcaccaccaagaatcagaacagaggcaacccagcagtttcgtatgtccgggttgtcactgtggccgcactgggcacaaatatttcaatccataaggacgagatcgggaaggtgcgggttaatggcgtgctcacagctctccctgtgtcggtggcagacggcagaatctctgtgactcagggggcatcgaaggccctgctggtggcagacttcggtttgcaagtctcctacgactggaactggcgggttgatgtgacgctgccttcatcataccacggcgcagtgtgtggcctctgtggaaacatggatcgcaaccccaacaacgaccaggtgttcccaaacggaacacttgcacccagtatcccaatctgggggggatcctggagggcacccggttgggaccccttgtgctgggatgaatgtcgaggaagttgccccacatgcccagaggaccggctggagcagtatgagggaccaggattttgcggccctctggctcctggcaccggtggtcctttcacaacatgccatgctcacgttccaccggagtctttttttaagggatgcgtgctggatgtctgcatgggcggaggagaccgagatatcctgtgcaaggctcttgctagctacgtggctgcatgtcaagccgctggggtggtcatcgaagattggagagctcaagttggctgtgaaatcacttgtccggagaactcacattatgaggtttgtggccctccttgcccagcaagttgtccgtcaccagcgccattaacgactcccgcagtctgtgaaggtccctgcgtcgagggatgccagtgtgacgcgggttttgtcttgtcggctgatcgctgcgttccactgaataatggatgcgggtgttgggccaacggcacctatcacgaagctggctcggaattctgggccgatgggacatgctcccagtggtgtagatgcgggcctggcggtggtagcttggtgtgcactccagcaagctgcggcttgggagaagtatgcggcctgctgccatcagggcagcatggctgccagccggtgtccacagccgaatgccaagcttggggagatccccactacgtgaccctggatggtcataggtttgacttccagggaacctgtgagtacctactgtccgcgccatgtcacggacccccattgggggcagagaactttactgtgaccgtcgccaatgagcaccgcggtagtcaagcggtgtcctacacaagaagtgtaacactgcagatatataatcacagcctgaccctcagcgccaggtggcctagaaaactgcaggtggatggcgtgttcgtaactttaccttttcagctggacagtttactgcatgcacacttgtcaggggctgatgtcgtggtgacaaccacatccggactctctttggcttttgacggggattcgttcgtgcgtttacgcgtgcctgctgcttacgccggaagtctgtgtgggctttgtggcaactacaaccaggaccccgctgacgatctgaaagccgtgggcggtaaacctgcaggctggcaggtgggcggagcccagggatgtggggagtgcgtgtccaaaccctgtcccagtccttgcacccctgagcagcaggaatcctttggcggacccgatgcctgtggcgttattagtgcgactgacggacccttggccccttgccatgggctggtccctcctgcccagtacttccagggctgtctccttgacgcctgccaggttcaggggcatccagggggtctgtgcccagctgtggctacatatgtggccgcatgccaagcagccggagcgcaacttagagagtggagacgtcccgatttttgcccattccagtgccccgcacattcacattatgaattatgcggcgactcttgccccggttcatgcccttctctctctgccccagaaggctgcgagtccgcttgtcgcgaaggatgcgtttgtgacgccggatttgtgctgtctggcgatacctgcgtgcctgtgggtcagtgtggttgcctgcacgatgaccggtactatcccctcggtcagaccttctaccccggaccaggctgtgactccctgtgtcgatgccgagagggcggagaggtgagctgcgagccaagtagctgtgggcctcatgaaacatgccggccatccggcggatctctgggctgcgtagctgtggggagcactacttgtcaggcttcaggagacccacactatacaacattcgatggccatcggttcgacttcatgggcacctgcgtctatgtcctggcccagacttgcgggacccggccaggactgcaccgcttcgcagtgttacaggaaaacgttgcctggggcaatggccgagtctcggttacccgtgtaatcaccgtccaggtcgcaaacttcaccctccggctggagcaacgccagtggaaggttacagtgaacggcgtcgacatgaaactgcccgtggtcctggccaatggccaaatccgcgcaagccagcatggcagcgacgtggtaatcgagactgatttcggcctgcgtgtcgcctacgacttagtttactacgtccgcgtgacggtacccggaaactattatcagctcatgtgtggactatgcggcaactacaatggggacccaaaggacgatttccagaagcccaatggctcccaggctgggaatgctaacgaattcggtaacagctgggaagaggttgtgcctgacagcccctgtctgcctcctccaacctgcccaccaggctcagccggatgtattccaagcgacaaatgtccccctgagctcgaaaaaaagtatcagaaggaagagttctgcgggctactgtcatcacctaccggtcctctgtccagctgccacaagctcgtggatccccagggccctctgaaggattgcatattcgacctctgtctgggtggcggaaacctgtcgattctctgcagcaacattcacgcatatgtgtcagcctgtcaggccgctggagggcacgtagaaccgtggagaaatgaaactttttgcccgatggaatgcccccaaaattcacactacgaactgtgcgcagatacatgctcactggggtgctctgcactgtccgcaccactccagtgcccagacggatgtgccgagggctgccaatgtgattctggctttttgtataatgggcaagcctgcgtgcctatccagcaatgtggatgctaccataatggcgtttattatgagcctgaacagacggttctcatagataactgtcgacagcagtgcacctgtcacgtcggcaaggttgtcgtttgccaagagcactcctgcaaaccaggccaggtctgccagccctcaggcggtatcttgagctgtgtcacaaaagatccctgtcacggggttacgtgccggccacaggagacttgtaaagagcagggcggacaaggagtgtgtctgcccaattatgaagccacctgctggctgtggggagacccacattaccacagtttcgacggaagaaagtttgatttccagggtacatgtaactacgtcttggctacaactggatgtcctggcgtctctacacaaggcttgacaccattcaccgttaccacaaagaaccagaatagaggcaatccggcagtgagctacgtgcgcgttgttaccgtggccgcacttggcacgaacattagtattcataaagatgagattggaaaggtcagagtgaacggcgtattaacggccctgcccgtcagcgtggctgacggcagaatctctgtagcccagggggcatcaaaggccctgctggttgctgattttggcctgcaagtctcctacgactggaattggagggtagacgtgacgctgccatcttcctaccacggggcagtctgcggtctctgcgggaacatggatcggaaccctaacaatgatcaggtgtttcctaatggcaccctcgccccttccatccccatctggggaggtagctggagggcccctggctgggatccgttatgttgggacgaatgtcgcggttcctgccccacatgtcctgaggaccgcctcgagcagtatgagggaccaggcttttgtggtcccttatctagcgggactggagggccatttacaacttgccacgcccatgtgccgcctgaaagcttttttaaggggtgtgtcctggacgtgtgcatgggtgggggtgatcgagatatcctgtgcaaagctctggctagctatgtagccgcatgccaggccgctggggtagtcatcgaggactggagagctcaagtgggttgcgagatcacttgtcctgagaattcacactacgaggtgtgcggtcctccgtgcccagccagctgtcccagtcccgcacctcttactactcccgctgtgtgtgaggggccttgcgtggagggctgccaatgtgatgcgggatttgttctcagcgccgatagatgcgtgccgttgaacaacggatgtggctgctgggctaatgggacgtaccacgaggccggttccgaattttgggccgatggcacctgtagccagtggtgccggtgtggcccaggcggaggctctctggtatgtacaccggcaagttgtggcctcggcgaagtgtgcggactgcttccttcaggacagcatgggtgccaacctgtgtctactgccgagtgccaggcgtggggagatccacattatgtcaccctcgatgggcatcggtttgacttccaagggacatgcgagtacttactcagcgccccatgtcacggccctcccttaggtgctgagaattttacagtaaccgttgccaatgaacatcggggatcccaggctgttagctacactcggagcgtgacactgcagatttacaatcactcgctaacactgagcgctaggtggccaagaaagttacaagttgatggcgtttttgttgcactgccctttcagctcgattcattactgcatgctcacctgtccggagccgatgtcgttgtcactaccacgtcaggtctgagcttggcattcgacggggacagtttcgtgaggctacgcgtacccgcagcctacgccgctagcctttgcggcctgtgtggcaactacaaccaagatcctgcagacgatctcaaagctgtgggtgggaaaccggctggctggcaagtgggcggagcccaggggtgcggagagtgcgtaagcaaaccctgtcccagtccatgcactccagaacagcaggagtcttttggcggaccagacgcatgcggcgtcattagcgccaccgacggccctctcgccccatgtcatgggcttgtgcctcctgcacagtactttcaggggtgtttgctggatgcttgtcaagtccagggccacccaggtgggctctgcccggcagtcgccacttacgtggcagcttgccaggcggcaggtgcacagctgggagaatggcgcagacctgatttctgtccgctgcagtgtcctgcacactcccattacgaattgtgtggagattcctgtccagtgtcttgtcctagccttagtgctcctgaaggctgcgagtctgcctgtcgtgaaggttgcgtctgcgacgccggattcgtgctcagtggagacacttgcgtccctgtaggacagtgtgggtgcttgcacgacggtaggtactatccgctgggcgaggtgttttaccccggtccagaatgcgaacgcagatgtgagtgtggccctggcggtcatgtgacttgtcaggagggagcagcttgcggaccccacgaggaatgtcggctggaggatggcgtccaagcctgccacgctaccggctgtggtagatgcctagccaacggtggaatccactatatcacgctggacgggagagtgtatgatctacacggctcttgttcctacgtgctcgctcaagtctgccaccctaaacctggtgacgaggacttctcaattgttcttgaaaaaaacgccgcaggagacctacagagattactcgtcacagtagctggtcaggtcgtgagtctggcccaaggacagcaagtaacagtcgacggcgaagccgtagctctgccagtggccgttggtagagttagggttactgcggaggggaggaacatggttctccaaacaaccaaaggactgagactgctttttgacggcgatgcgcatctgctcatgtcgatccccagcccctttcgtggtaggctgtgcggactctgtggcaactttaatggcaattggtccgacgacttcgtcctccccaacggctctgccgctagctccgtcgagacattcggcgctgcgtggagggccccaggtagctccaaggggtgtggggaagggtgtggacctcaaggctgtccagtgtgcctggccgaggagaccgcaccctacgagtccaatgaagcctgtgggcaactgagaaatccccaggggccatttgccacttgccaggcagtactgagccctagcgagtatttcaggcagtgcgtgtacgacctgtgtgcccagaaaggcgataaagcatttctgtgccggagcttagcagcatacacagctgcttgccaagctgcaggcgttgcagtgaaaccgtggcggacagattccttttgtccgttgcactgtcctgcccattcacactatagcatctgcacccgaacctgccaggggtcttgtgcagcactatccgggctaacggggtgcaccacccgctgcttcgaagggtgtgagtgtgacgacagatttctgctaagtcagggagtgtgtataccagtgcaggattgtggctgtacacacaatgggagatatctccctgtgaacagttcgctgctcaccagtgattgcagtgagcgttgttcatgctcttcctcctctgggctgacgtgtcaggccgcaggatgtcccccagggagagtgtgcgaggtgaaggctgaagccagaaactgctgggccactagaggcctctgcgttctgagcgttggtgccaacttgaccacattcgatggggctcgaggtgcaactacatctcccggagtttatgagctttcatctagatgccccggtctgcagaacacaataccctggtaccgggtggtggcagaggtccagatttgtcatggaaaaactgaggccgtgggacaggtacacattttctttcaagacggaatggtgaccttgaccccaaataagggagtgtgggtgaacggtttacgagtggacctgcctgccgagaagttagcttccgtgagtgttagcagaacccccgacggcagcctgttggtgcgccagaaagctggagttcaggtctggctaggagccaacggcaaggtcgctgtgattgtgtctaatgaccatgccggaaaattgtgtggggcatgcggcaattttgatggggatcagaccaacgactggcacgattctcaggaaaagcctgccatggaaaaatggcgagctcaggatttctctccctgctacggata

SEQ ID NO: 25851 - DNA, 2502 bp, Artificial Sequence
  Description of Artificial Sequence: Synthetic coding sequence
atggttcatgggagtgtcacattccgtgacgtcgcaattgactttagccaggaagaatgggagtgtctccaacccgaccaacgcacgctctaccgggatgtaatgctggagaactactcgcacctcatctccctcggatcttccattagcaagcccgacgtcattacactcctcgaacaggaaaaagagccttggattgtggtgtctaaggaaacgtccagatggtatcccgatctcgaaagcaagtatgggccagaaaagatcagccccgagaatgacatatttgaaattaatctaccaaagcacgtaatcaaacagatttccaagactctgggtctagaagctttttacttcaggaacgactccgaataccgatcacgattcgaggggagacaaggacaccaggagggatacatcaaccagaagattatttcttacgaagaaatgccagcctatacacacgcctcaccgattcataatactcacaaaccttatgagtgcaaggaatgtggcaagtacttctcatgtggcagcaatctgattcaacaccagagcatccatacaggtgaaaagccttataagtgcaaagaatgcggcaaggcattccaactccacattcagttgacacgccatcaaaaattccacacaggcgagaagaccttcgaatgtaaggagtgtggcaaagcattcaatctgccgacccagctgaaccgccacaagaatatacacaccgttaaaaagctgttcgaatgcaaggagtgcggcaaatctttcaatagatcttccaacctaacccaacaccagtccattcatgccggagtgaagccataccagtgcaaagaatgcggcaaggcctttaaccggggtagcaatttgattcagcaccagaagattcactcgaatgagaagccatttgtgtgtcgtgaatgcgaaatggcgtttcgctatcactatcagctgatagagcactgcaggatccatacaggggaaaagccttttgaatgcaaagaatgtagaaaagcttttacgctcctgaccaaactggtaagacaccagaagatccatatgggcgagaagcccttcgagtgccgagagtgcggcaaagccttctctctcctgaaccagttgaataggcacaagaacattcacacaggagagaaacccttcgaatgcaaggagtgtggcaaatcttttaatcggtcatccaacctgattcagcatcaaagtattcatgcagatgtgaagccttatgagtgcaaagagtgcggaaaggggtttaaccggggagcaaacctcatccagcatcagaagattcactctaacgaaaaaccattcgtgtgccgagagtgtgaaatggctttccggtaccattaccagcttatacagcactgccaaatccatactggcggaaaacctttcgaatgtaaggaatgcggaaaagctttcagtttgctgactcaactagcccgacacaaaaatatccacaccggagaaaagccttttgagtgtaaagactgtgggaaggcgtttaacagagggtcgaatttagtgcagcaccaaagcatccacactggtgagaagccttacgagtgtaaagaatgcggaaaagccttcagactacacttacagttaagtcaacatgaaaagacgcacaccggagagaagcctttcgaatgcaaagagtgcggtaagttcttccggcgtgggagtaacttgaatcagcacagaagtattcataccggaaagaagcctttcgagtgtaaagagtgtggcaaggctttcagactgcacatgcatctgattcggcaccagaagttccatacgggcgagaagcctttcgaatgtaaggaatgtggtaaggctttcagcctgcatacacagttgaaccatcacaagaacattcacactggggagaaaccatttaaatgtaaggaatgcggaaaaagctttaatcgcgtttcaaaccttgtacagcaccagagtattcatgcaggcgttaaaccttatgaatgtaaggagtgcggcaagggatttagtagggtctcaaacctgatacagcaccagaagactcattcaagcgccaaaccttttgtttgtaaggaatgccgaaagacctttaggtatcactatcaactgacagaacattaccgaatccacaccggtgagaagcccttcgaatgtaaagagtgcggaaaggctttcggcctattaacacagctggcccagcaccagattatacatacgggtgagaaaccgttcaagtgtaaggagtgcggtaaagctttcaatcgtggatcaaatttggtgcagcctcagagcatccacacaggagaaaagccttatgagtgtaaggaatgcggcaaggctttccgcctgcatctacagctcagcctccatcaaaagctagtgcaggtgaggaatccactgaatgtgcgcaatgtgggccaaccttccgacatttcatccaatttactgaacatccggaagttcatcctgggatag

SEQ ID NO: 25852 - DNA, 618 bp, Artificial Sequence
  Description of Artificial Sequence: Synthetic coding sequence
atgaacacctttcaggcttccgtgagtttccaagatgttacagtcgaattctcacaagaggaatggcagcacatgggccctgtagagcgaacactatacagggatgtcatgctggagaactacagtcatctggtcagcgtgggctactgcttcacaaaacccgagctgatctttaccttggaacagggtgaggacccatggttactcgaaaaggaaaagggcttcttgtcaaggaactctcctgaagactcccaaccggacgaaatttctgagaagagtccagagaatcaaggaaagcatctcttgcaggtcttattcactaacaagttactgaccactgaacaggagatctctgggaaaccccataaccgggacatcaatatctttcgggcacgcatgatgccatgtaaatgtgacatcgcaggaagtgcctgccagggcttaagtctgatggctccgcattgtcagtacagcaaagaaaaggcccacgagagaaatgtgtgcgataagtggctcataagtatcaaggatggcaggacaaacacccaggagaaatcgtttgcatactccaaaatcgtcaagacgctgcaccacaaggaggaagttattcagcattag

SEQ ID NO: 25853 - DNA, 2100 bp, Artificial Sequence
  Description of Artificial Sequence: Synthetic coding sequence
atgaataccttccaggcgtcggtgtctttccaagatgttaccgtggaattcagtcaggaagaatggcagcacatggggccagtggaaagaaccctgtacagagatgtcatgctggaaaactactcacaccttgtgtcagtcggatattgctttacaaaacctgagctgatcttcacgctcgagcaaggggaagacccttggctccttgagaaagaaaaagggttcctctcgaggaacagccccgaggatagccagcctgacgaaattagcgagaaaagccctgagaaccagggaaagcacctgcttcaagtactgttcaccaacaaactgcttaccaccgaacaggagatcagcggaaaacctcacaatcgcgatatcaacatctttcgagcacgcatgatgccgtgtaagtgcgacatcgcgggttcagcttgtcagggcctcagtctgatggcaccccactgtcagtactccaaagagaaggcacacgagagaaacgtctgcgataagtggctaatatctattaaggacggcaggactaatactcaagagaagagcttcgcatattcaaagattgtcaagaccctgcaccataaagaggaggtgattcaacatcagactatccaaacactcgggcaggatttcgaatacaacgaaagtagaaaggcattcctcgaaaaggcggcactggtgacctctaactccactcaccccaagggcaaatcttacaattttaacaaattcggtgagaataagtacgacaagtctaccttcataataccacagaacatgaaccccgagaagagtcactatgagttcaacgacacggggaactgtttttgcagaatcactcacaaaacactgacgggagggaagtcattcagccagaagtctcacattagggagcaccatcgcgttcacatcggcgttaagccattcgagtacgggaaaagctttaatcgaaattccacactccctgtccatcaacgaactcatgcaacggacaagtatagtgactatcacccctgcacagagaccttctcttatcagagcacgttctctgtccaccaaaaggtgcacattcgggctaagccgtatgagtacaatgaatgcggcaaatcctgctccatgaacagccacctaatctggcctcagaaatcccacacaggcgaaaagccttacgaatgtcccgaatgtggaaaggccttctccgagaagtcacgcctccggaaacaccaaaggacacacactggggaaaagccatataaatgcgatggctgtgacaaagcattttcggcaaagagtggtctgcgaattcaccaaagaacgcatactggggagaaacctttcgagtgtcacgaatgtggaaagtctttcaattacaagagcattctcattgtgcaccagcgcacacatacgggagagaagcccttcgaatgtaacgaatgtggtaaaagcttttcccacatgtccggcctccggaatcatagacggacccacactggagagcggccatacaaatgcgatgaatgcggcaaggcttttaagttgaagtcaggcctcagaaaacaccatcgcacacacacaggagaaaaaccctataaatgcaaccagtgtggcaaagcctttggccaaaagtcacagttacgcggacatcatcggattcacacaggagaaaagccctacaaatgcaaccactgtggggaggcattctcacagaagtccaatctgcgcgtgcaccaccgaacgcatactggtgaaaagccctatcagtgtgaagagtgtggaaaaactttcaggcagaaaagcaacttaagaggccaccaaagaactcatacgggggaaaaaccctatgagtgtaatgagtgcggaaaagccttctcagaaaaatccgtgctgcgtaagcaccagagaacccatactggcgagaaaccttacaactgcaaccagtgtggcgaagcattctcccagaagtcaaatcttcgtgtacatcagagaactcatactggagaaaaaccgtacaagtgtgacaagtgcggccgaacgttcagccaaaaatcctctcttagagaacaccagaaagctcaccctggcgattag

SEQ ID NO: 25854 - DNA, 1704 bp, Artificial Sequence
  Description of Artificial Sequence: Synthetic coding sequence
atgatgccctgcaagtgtgatattgccggttcagcctgtcagggcctgtccctcatggctccccactgccagtattctaaagaaaaggcgcatgagcggaatgtgtgtgataaatggttgattagcatcaaggacggcaggacgaacactcaggaaaaatccttcgcctatagcaagatcgtaaagacccttcatcacaaagaggaggtgatacagcaccagaccattcaaaccttgggacaggactttgagtacaacgaaagtagaaaggcatttcttgagaaagcggctctggtgaccagcaattctacgcacccaaagggaaaatcttataatttcaacaaattcggtgaaaacaagtacgacaagagtacttttatcattccgcagaacatgaatcctgagaaaagtcactatgaattcaatgacacaggcaactgcttctgtcgaatcacccacaagaccctgacaggcggaaagtcattctcccaaaaaagtcacatacgggaacaccaccgagttcatatcggcgtaaaacctttcgaatacgggaagtccttcaaccggaattccacgcttcctgtgcaccagcgcacacacgcgactgataaatactcagactatcacccttgcactgagacattctcttatcaatccaccttttcagtgcaccagaaggtgcatatcagggctaaaccatatgagtacaacgagtgcgggaagagctgtagcatgaattcacatctcatctggcctcagaagtcccatactggcgagaaaccttatgaatgcccagaatgcgggaaagccttctctgagaaatcacgcctccgcaaacaccagagaacccacactggtgagaagccttacaagtgcgatggctgtgataaggccttcagtgctaaaagcggcctgagaattcatcaacggacccatacaggggagaagccttttgagtgtcatgagtgcggaaaaagctttaactataagtcaatccttattgtacatcagagaacccataccggcgagaagccctttgaatgtaacgagtgtgggaagtctttctcccacatgagcgggttgcgaaaccacagaaggacccacactggcgaacgtccctataaatgcgacgaatgcggcaaggctttcaaactgaaatctggcttgaggaagcatcaccgaacccatactggcgagaaaccttataagtgtaatcagtgcggcaaagccttcggccagaagtcccagttgcgtggccaccatcggatccacaccggagaaaaaccttacaagtgcaaccattgtggggaggccttcagtcaaaagagtaaccttagggttcatcacaggactcacactggcgaaaaaccttatcagtgtgaagagtgtggcaagacgtttcggcagaaaagcaatctgcggggacatcagagaacccacaccggtgaaaagccctatgagtgcaatgagtgcgggaaggcattcagcgagaagtccgtacttcgcaagcatcagaggacccacaccggcgaaaagccctataactgtaatcagtgtggggaagccttcagtcaaaagagcaatcttagggtccaccagcgcacgcacaccggtgaaaaaccctacaagtgcgacaagtgcggtcggaccttttcccaaaaatcatctcttagagagcatcaaaaggcccaccctggggactag

SEQ ID NO: 25855 - DNA, 972 bp, Artificial Sequence
  Description of Artificial Sequence: Synthetic coding sequence
atggcagccgcaaggcccgaggcacagtctcgatccagcccaaccccagagtccaggagccaggagccgctggatctggttctggtccctgatgattgtcgccctggaacacctccatcagatttaatcgagatccaggtggtcaaagtgactgataccaccttggtccccgagccgcctgaaccgggaagctttcattgcgctctgtgccctgccgcttttaggttagtctctgagctcctgttccatgagcacggccacttagcgggagcggagggtggtggccagggaggcgacccaagtagatgccatgtctgtgggcattcatgtcccggacctgccagcctgcgagcccattacagcctgcacaccggcgagcggccatacagatgcgctttgtgccccagagccttcaaggcattggccccacttctaaggcaccagcaccgacacggcgtggagcctggaaccagcagacggccacccgacaccgccgctgtcgcagagcagcggcctggcgtggccccagagcgcgctgaagtggtgatggcagccgcagcagctggcgctgctgtaggtaaacccttcgcatgcagattctgcgcaaaaccgtttcggaggagctccgacatgcgcgatcacgagagggtgcacactggcgagcggccatatcactgcggcatctgcggcaagggctttacccagtcttctgtattaagcggacatgccagaatccataccggcgagagaccgttcagatgcaccttgtgcgatagaacgtttaataacagctcaaacttccgcaaacaccaacgcacacacttccatggtccgggtcctggcctcggggattccgggggacagttgggttcgtctgcggctgaaggaagtggatcagggtgcggcgttggagatccagcagaggagggcaggggggaaacagcgaaggttaaagtggaggcggatcagtag

SEQ ID NO: 25856 - DNA, 1218 bp, Artificial Sequence
  Description of Artificial Sequence: Synthetic coding sequence
atgggaccgcctcttgccccaaggcccgctcatgttcctggcgaggccggaccacggcgtacacgagagtcccgtcccggtgccgtaagcttcgcagatgttgccgtttatttcagtccggaggagtgggagtgcctccgcccagctcaaagagccctgtatcgggacgtgatgcgggagaccttcgggcacctcggcgctctcgggtttagcgtccctaagccagcttttataagttgggtggaaggagaagtggaagcgtggtcccccgaggcccaagaccccgatggtgaaagcagtgccgcattttcaaggggtcaaggccaggaagctggatctcgagatggcaacgaggagaaggagaggctgaagaaatgcccaaaacagaaggaggtcgctcacgaagtggctgtgaaagagtggtggccatctgtggcgtgtccggaattctgtaacccaaggcagagcccaatgaacccctggctcaaggacaccttgactcgcaggctgccgcactcatgcccggactgcgggcgtaatttctcctacccaagtttgctcgcatcacatcaacgcgtccattcgggggagagaccttttagctgtggccagtgtcaggccaggttctcccagagaagatatttgctgcagcatcaattcattcacaccggcgagaaaccatatccttgcccagactgcggcagacgctttagacaacggggttccctggcaatccaccgtcgcgcacataccggcgaaaagccatatgcctgttcagactgcaaatctcggttcacatatccatacttactggccatccaccagcggaagcacactggtgagaagccttacagctgtcccgattgcagcctgcgattcgcttacacatctttgctagccatccatcgcagaattcatactggagaaaaaccatacccttgccccgattgcggcaggcgcttcacatactcgtctctattgctctctcatcgcagaattcatagtgatagcagacctttcccctgcgtggagtgtggaaaagggttcaagcggaaaactgcgcttgaagcccacaggtggattcacagatcctgctcagagagacgcgcttggcagcaggccgtggttggccgtagcgaacctattcccgtgctcggcggtaaggacccacccgtgcatttccgacatttcccagatatctttcaggaatgcggctag

SEQ ID NO: 25857 - DNA, 1113 bp, Artificial Sequence
  Description of Artificial Sequence: Synthetic coding sequence
atgccagcagcttcggccgagggccctgtgccaggccgagacgctggggatctgcgccctcctggacgggctgggcgtgcacactgcttctcatttgcgggattttcagtccccaagcccgctttcatctcttgggtggaaggggaggtggaggcttggtcccctgaagcacaggaccccgatggtgaatcctcagctgcattttcgcgcggtcaaggccaagaggccggtagtcgggacggcaatgaagaaaaagaacgcctcaaaaaatgtccaaagcagaaggaagtagcccacgaggtggccgtcaaggaatggtggccttctgtggcctgcccggagttttgcaaccctcggcagtcccctatgaacccttggctgaaggacacattgactagaagactcccacattcctgtcccgactgtggtaggaacttttcctatccatcgctgttggccagccaccagagagtgcattcaggcgagcggccattttcttgcggccagtgccaagccaggttctcacagcgtcggtatcttctgcaacaccagttcatacacacaggagagaagccctatccttgccctgactgcgggaggaggttcaggcagcgcggaagcctcgcaatccaccggcgtgcacacacaggcgaaaaaccgtacgcatgcagcgattgcaaatcacggtttacctacccctatctgctggcaattcaccagaggaagcacaccggtgagaaaccttactcttgccctgattgttcattgaggttcgcttatactagtctcctcgcaattcataggcgcatccacacgggagagaagccctatccctgtcccgactgcggcagacgttttacatattcgtcactcctactctcccacaggaggatacattctgacagtagacccttcccatgcgtcgagtgcggaaaaggattcaagaggaaaacagcacttgaggcacatagatggattcacaggtcttgcagcgagcggagagcctggcagcaggcagtagttgggagatcggaacctattccagtgttgggaggcaaggacccacccgtgcattttcgccacttcccagatatatttcaggagtgcggctag

SEQ ID NO: 25858 - DNA, 1173 bp, Artificial Sequence
  Description of Artificial Sequence: Synthetic coding sequence
atgggccctccattggccccacgcccagcacatgtgcccggagaggccggaccaagaagaacccgcgaaagccgccctggcgctgtatcgtttgctgatgttgcagtctatttttcccccgaagagtgggagtgtctgaggccggctcagcgcgctctctatcgggatgttatgcgggagaccttcggtcacctgggtgctctgggatttagcgttccgaaaccagccttcatctcgtgggtagagggagaggttgaggcttggtcccccgaggcacaagacccagatggaagccgggatggcaacgaagaaaaggagcgcctgaagaagtgtcctaagcagaaagaggtcgcacacgaagtcgccgtgaaggagtggtggccatccgtcgcttgccctgagttctgcaatcccagacagagtcccatgaacccctggttaaaagacaccctgacacggaggctcccccactcttgcccagactgtggcaggaactttagttaccccagccttcttgcctctcatcagcgtgtccattctggtgagcggccattttcttgcggacagtgccaggctaggttttcccagagacggtacttattacagcatcagttcattcatactggagagaagccgtacccctgccccgactgtggaaggcggttccggcagagggggtctcttgccatccacagacgcgcacatactggggagaagccctatgcatgcagcgactgcaagtctcgatttacttacccctacctgctggccatacaccaacgaaagcatactggcgaaaagccttacagctgcccagactgttcactccgctttgcttacacgtccctcttggcaatccatcgaagaatacacaccggagagaagccctacccctgtcccgattgcggccgtaggttcacttacagttctctgctactgagtcacagacgcattcactctgactcaaggccttttccatgcgtggagtgcggaaaggggtttaaacgcaagacagccttggaggctcaccggtggattcatagatcctgtagtgaaagacgcgcatggcagcaggccgtagtgggtcggtccgaaccaatcccagtgctgggagggaaagatccccctgttcattttcgacactttcccgatatcttccaagaatgcggctag

SEQ ID NO: 25859 - DNA, 2238 bp, Artificial Sequence
  Description of Artificial Sequence: Synthetic coding sequence
atgcggtcgaactacgagacactcgtgagcctggacgacgggttgcccaaaccagagctcatctcttggatcgagcacggtggcgagccatttaggaaatggagggagtcccagaagagcggtaatatcatctgctcatcagtggatatgcactttgaccccggatttgaagaacagctattctggggctcccagcaggccatgaacagtggtaagaccaaatcacactttcagctggatcccgagtctcagtgcagttttgggagttttgtctctttcagaccggaccaggggattacacttgggtccccacagcgacacgatgctagggcacctcctcctctggcatgcggccctagtgagtccaccctcaaggagggcattccagggcctaggaatctggacctgccaggcctgtgggacgtccctgcttgggagtcgacacagcacccctggccggtgtgtggtgaatcctgctgggagaataaccacctggtgatgcaccagaggggccatagcaaagaccgaacacgccgagcatgggagaaattcaacaaaagggccgaaactcaaatgccttggtctagcccaagagttcagcgccattttcgctgtggcgtctgcggcaagtccttccggaggaaactgtgtttgcttcggcaccttgccgctcacaccggtcggggtcccttcaggaacgctgacggcgagatgtgcttccgtcatgagctgacccatcctagtcatcgcctccctcagcagggggaaaagcctgcacagtgcacaccatgcggtaagaggagtttgccagtcgactcgacccaggctcgccgttgccagcacagccgcgaaggtccagcctcttggagggagggacggggtgccagtagctccgtgcattcgggtcaaaagccaggaagccggctgccccaggagggcaacagccatcaggaaggtgatactgaagcattgcagcatggcgcagaagggccatgttcctgctccgaatgcggtgagcgctccccaatgagtgcgcgtttggcgtctccatgcagggctcatacaggcgagaaaccgttccagtgtgctcactgtacaaaacggtttaggctccggcgactcctgcaagtgcaccagcacgctcacgggggagagcgtccctttagctgtcgcaagtgcggaaaaggatttgccaaacagtgcaaactgactgaacacattagggtccacagtggggaaaagcccttccgatgcgccaagtgtggaaggaactttagacagcgaggccaacttctgaggcatcagaggctacacaccgatgagaagccctttcagtgccccgagtgcggtctgagcttccgcttagagagtatgctgcgcgctcatagactgcgccacggtggtgagagaccctttagttgctcagaatgcggaagaggattcacacatcaatgcaagctccgcgagcacctgagggtccattccggtgagcggccattccagtgcctgaaatgtgataagagatttcgtctaaaaggtattttgaaagcgcatcaacacacacattcgaaggaaaggccatttagctgcggggagtgtggtaagggctttaccagacagtccaaactcacagaacacctgcgcgtgcactccggcgagcgacctttccagtgtccggagtgcaaccgcagcttcaggcttaagggccagctgctctcacaccagcgcctccataccggtgagagaccctttcagtgcccggagtgcgataagcggtatcgagttaaagcagatatgaaagcacatcaattactgcacagcggggagatgcctttttcctgtgagtgtggaaaaggctttgttaagcattccaagcttatcgaacacattcgtactcataccggtgaaaaaccctttcagtgtcccaaatgtgataagagctttcggcttaaggcccaactcctttcccatcagggcctgcacactggcgaacgacctttccattgcccggagtgcgataaaaactttcgggagaggggccacatgctccgtcatcagcgcatccacaggccagaaaggccattcgcctgtggagactgcggaaagggattcatctacaaaagtaagttggccgaacatattagagtgcacacaaagtcttgtccagcaccaaatgaacttgacataaaaaaacgcttgagccagctgtttgctatgatcgaggccgattggtcctag

SEQ ID NO: 25860 - DNA, 2349 bp, Artificial Sequence
  Description of Artificial Sequence: Synthetic coding sequence
atggcagagccccctaggctaccactgactttcgaggatgtcgcaatctacttttctgaacaggagtggcaggatctggaagcttggcaaaaagagctatacaagcacgttatgaggagcaattatgagaccctagtgtccctagacgatggcctaccaaagcctgagttgatctcatggattgaacatgggggagaaccatttagaaagtggagagaatcccagaagagcggtaacattatttgtagcagcgtggatatgcacttcgaccccggttttgaagaacagctcttctggggcagccagcaggcgatgaatagcggaaaaacgaagtctcatttccagctggatccggagagtcagtgtagctttggatcatttgtgtcatttagaccagaccaaggcattaccctgggcagcccccaaagacacgatgccagagcaccacctccactcgcctgcgggccttctgaaagtacgctcaaagagggtataccaggaccgagaaatctcgatctgccagggctgtgggacgtcccggcatgggaaagcacccagcacccatggcccgtgtgcggagaatcctgctgggaaaacaatcatctggtaatgcatcagcgagggcacagcaaggacaggacacgccgagcgtgggaaaagttcaataagcgagcggagacccagatgccctggagtagccctcgcgtgcagagacacttccggtgtggtgtgtgtggtaagtcattcaggaggaagctttgcttgctgcgtcatctcgccgctcacaccggacgcggacctttccggaacgctgatggagagatgtgtttccgccatgagttgactcatccctcccatagactgccacaacaaggcgagaaaccagcgcagtgtaccccttgtggaaagcggagtctgccggtagactcaacgcaggcacggcgatgtcagcattcacgggaggggccagcttcgtggagagagggccgaggtgcgtcttcaagcgtgcatagcgggcaaaagcctggctctcgcctgccacaggaggggaactctcatcaggagggtgatactgaagcactgcagcatggggctgagggcccatgttcttgtagtgaatgcggagagcgatcacctatgtcggctcggctagcctccccttgcagggctcatacgggagaaaaacccttccaatgtgcacactgcactaaacgctttcgacttcggcgacttctgcaggtgcaccagcacgcgcacgggggagagaggccatttagttgccgcaagtgtggaaaaggctttgctaagcagtgcaagctaacagagcacatcagagtacactcgggcgaaaaaccttttagatgcgccaaatgcggtcggaactttaggcagcggggtcagttactgaggcatcagcggctgcacactgatgaaaagccctttcagtgccccgaatgcggactgtcctttcggctggagagtatgttacgagcccaccgactgagacatgggggagaaagacccttttcctgcagcgagtgtggtcggggattcacgcatcagtgcaagctccgtgaacacctgagagttcactcgggagaacggccatttcagtgcttgaagtgcgacaagcggttccgcctgaaaggcatcctgaaagcccaccagcatactcactctaaggaacgtccgttttcatgtggagaatgtggtaagggatttactcgccagtcaaaacttaccgagcatctgagggtacattccggtgagcggccttttcagtgtcctgaatgtaatcggtctttcaggctgaaggggcagctgctttctcaccagcgcctccatacaggcgagagacctttccagtgtcccgaatgtgacaaaaggtaccgggtgaaagcagatatgaaggctcaccaactactacactctggagagatgccgttttcttgcgagtgtggaaaagggtttgtgaagcactccaagctgattgagcacatacgtacccatacaggagagaagccttttcagtgtccaaaatgtgacaaaagtttccgcctaaaggctcagttattatcccaccagggtctgcatactggggaacggccattccactgcccagaatgtgacaaaaacttccgggagcgcggacatatgctgcggcatcagcggattcataggccagagaggccctttgcatgtggcgattgtgggaagggattcatctataagtcaaaactggccgagcacattcgcgtccataccaagagctgccctgctcccaacgaactggacattaagaaaagattgtcccaactgtttgccatgatcgaagccgactggtcttag

SEQ ID NO: 25861 - DNA, 1056 bp, Artificial Sequence
  Description of Artificial Sequence: Synthetic coding sequence
atgcactttgatcccggattcgaagagcaactgttttggggctcacagcaggccatgaatagcgggaaaaccaaaagccatttccagctggatccggaatcacagtgttctttcggcagcttcgtgagttttcggccagatcaggggataacattgggctcgccccagcgacacgacgctagagctccaccaccactggcgtgcggcccatccgagtccacgcttaaggagggcataccgggaccacgaaatctcgaccttcccggtctgtgggacgtgccggcttgggaaagtacccagcacccctggcctgtttgcggtgagagttgttgggagaacaaccacctcgttatgcaccagcggggacattccaaggacagaacccgaagagcgtgggaaaaattcaacaagcgcgctgaaactcagatgccttggtcgtctccaagagtgcagaggcatttccgttgcggagtctgcggcaagtcttttcggagaaagttatgtttactgcgccacttggccgcacatacgggcagggggccttttagaaacgccgatggggagatgtgctttagacatgagctgactcacccttcacatagactgccacaacagggcgaaaagcccgctcaatgtaccccctgcggtaaacgaagtctgcccgtcgattccactcaagcccgaagatgccagcatagtcgcgaaggccctgccagctggagagaggggcgaggtgctagctcctctgtgcactcggggcagaagccaggcagccgtctgcctcaggaggggaatagccaccaggagggtgatacagaagctctgcagcatggtgccgaaggcccatgttcctgttctgaatgcggcgaaaggtcccccatgtcagcccgactcgcttccccatgtagagcccacaccggagagaaacccttccagtgcgcccactgtacaaaacgcttccgcctgcgcaggctgctgcaggtccaccagcatgcccacgggggtgaaacagtactcctccaggaggtatggcagggactccgacaggcagtgtag

SEQ ID NO: 25862 - DNA, 1152 bp, Artificial Sequence
  Description of Artificial Sequence: Synthetic coding sequence
atggaactcagagaggaggcttggtccccaggacccttggattctgaagaccagcagatggcctcacacgagaatcccgtcgacatcctcatcatggacgacgacgatgttccttcttggcctcctacgaagctgtctccaccccagtctgcaccccctgccggtccaccaccaagaccaagacctccagccccttacatctgtaatgagtgtggaaaatcgttctcgcattggtctaaattaacacgccaccagagaactcacaccggagaacggccaaatgcatgtgcagactgtggaaaaaccttttcccagtcctcccatcttgttcaacatcgcagaatccacaccggtgaaaaaccttatgcatgtctcgagtgtgggaagcggtttagctggtcatctaacttaatgcaacaccagagaatccatacgggggaaaagccatatacatgcccggactgtgggcgaagtttcacccaaagcaaatccctggctaaacatcgacggtcccattccggcctgaagccctttgtgtgcccacgctgtggcagaggtttttcccagccaaaaagtctggcacggcatttgcgattgcacccggagctgtctggccctggggtcgcagctaaagttctggcagcatctgtgcgtagagctaaagggccagaggaggccgtggctgcagatggcgaaattgccatcccggtaggggacggcgaaggcattattgttgtgggggcaccaggcgagggtgcggctgcggctgctgccatggctggggcaggagccaaggccgctggtccaaggtcgcggcgagcccctgcacccaagccctatgtgtgcctagaatgtgggaaaggattcggtcacggagcgggactgctggcccatcaacgagcacagcacggggacgggctgggtgccgcagggggagaggaacctgctcatatctgcgtagaatgtggcgagggttttgtgcagggggctgccctgcgaaggcataagaagatacacgcagtaggagctcccagcgtgtgcagttcctgtggccagagctattaccgcgcaggcggtgaggaggaagatgacgatgacgatgaagccgctggcggtcgctgccctgaatgccgtgggggagaaggcagatag

SEQ ID NO: 25863 - DNA, 1848 bp, Artificial Sequence
  Description of Artificial Sequence: Synthetic coding sequence
atgaacgtccggatcttacgcaggcacttagtgttcccattcatcttcatagtcatcaaggagctgactttagagggtacacccatgaatgttaacaatttggagaatcccctcgatgccccacagaactttaagtgcatgcagggcctgagtgtggagaagccgtataaatgcaagaagtgtgagaaggcctttaacaacttgtcatctttccagatccatgaacggatgcaccggggtgggaagtatcacgcttgcaagggaagtggtaacacttaccgattcagcggcttttatcacagacataaaatgcctcatgcagggggtaagttctatgggtgcaaaaaatgcgggaaagcctttattagcttttgcgctttcaggtaccatcagcggacccacacaaaggagaagccttacgcctgcaagcagtgtggcaaggcctatattagttatacatcttttcagtaccaccagctgaaccataccggagcaaagtgctacgaatgcaagcagtgcggtaaaggttttgacctgccaaatagtattcggtaccatgaaatgacacacactggggaaaaaccacatgagtgtaagcagtgtggcaagacttttcgctgcgctagctcacttcgtatccacggaagaactcataccggggaaaagccgtacgagtgcaaacagtgcggcaaggtatcacgttattggagcggcctgcaggtgcatgaagttactcatattgggaagaagttatacgaatgtaaggagtgcggcaagagttactactcttccggctccttcctgaaccacaagcgtattcacaccagagagaagagttatgagtgcaaggaatgcggcaaagcctttgggaacccgatttcatttcagaagcacgagggatcgcatagaaaatggaaaccttatgaatgtaaggagtgtggtaaggtgttctctttctctagcagtcttaggaggcatgagcgtacccacactgagaagctctgtgaatgtaaacagcacggaaaggggtttttccacaggagctgccctcggcatatgaagatcgataccggtgagattctgcacaagcgcaagatccgcggtaaagtgtttcatagcccttcctcctttcagacttgtgagaggtctcacacacgtgaaaagaggtacaaatgcaaacagtgcggtaaaccttttatttattttaatgcattccagcgccatcagcgctcacacaccggagaaaacccatatgagtgtaagcagtgcggtaaggcttgcatcagttcaacagcctttcagtgccgggaactctctcatactggtgccaagcggtacaaatgcaaacagtgcggtaagggattcaatcttccaagttctattcggtatcatgaaatgacacataccggcgaaaaaccctacgaatgcaagcagtgcgggcgagcgtttcggagcgcctcccatctgcggacacacgagcggactcatataggagaaaagccctatgaatgtaaacaatgtggaaaagtctacaggtactggtctggacttaggatccatggtctaacccatatcgggaagaaaccgtacgaatttaatgaccggggaaagtcgttctatagcagtaattttttcctcaatcacaagagagtacatacacgcgtgaaaacgtatgaatgcaaggaatgcggcaaagcattcgacaacccgacatcattccaaaaacatgaggggagccatagaaaaggcaaatcttacgagtgcaaagagtgtggtaaggtctttagtttctcccgctcatttagacggtacgaaagggcccataccggcgaaaagccgtgtgaatag

SEQ ID NO: 25864 - DNA, 780 bp, Artificial Sequence
  Description of Artificial Sequence: Synthetic coding sequence
agatctcatacccgcgagaaacgctacaagtgtaaacagtgcggaaagcccttcatttactttaacgctttccagcgacatcagcggtcgcacacgggagagaatccctacgaatgcaagcaatgcgggaaggcctgtattagttccacagcattccaatgccgcgagctctcccatacaggggctaagagatacaagtgcaagcagtgcggaaaggggttcaacctacctagcagcataaggtatcacgagatgacacacaccggggagaagccttacgaatgtaagcagtgcggccgagcattcaggtccgccagccatctgcgcacacatgagcgaacccatattggagagaagccatacgaatgtaaacaatgcggcaaagtctacagatactggtctgggttgaggatacatggcctcacgcacattgggaagaagccctatgagtgcaaagaatgtggcaaggccttcgacaatcccaccagtttccagaaacacgaagggtcccaccgcaagggcaaatcctacgagtgtaaggaatgcgggaaggtgtttagcttcagccgtagtttcagacggcacgggcgtatgcataccggggaaaaaccatatgaatgcaagaactgcggaaaagcctttacttctgccaaatctctgcagaaccatggcagaacccacactggagagaaaccttgtgaatgtaagcaatgcggcaaggcatttatctgtagttcgtcctgccagagacacgaggagacacactccgtgaatatgtag

SEQ ID NO: 25865 - DNA, 1278 bp, Artificial Sequence
  Description of Artificial Sequence: Synthetic coding sequence
atgtttccaccagctcgagggaaggaactcctaagtttcgaagatgtggccatgtactttacgcgggaggaatggggccatcttaactgggggcagaaggatctctacagagatgtcatgctcgagaactaccggaacatggtgctgcttggcttccagttcccaaaaccagaaatgatttgccaattggaaaattgggatgaacagtggatcttggacctgccccgaaccggtaacaggaaagccagtggatcagcctgtcctggcagtgaggcaagacataaaatgaagaagctaacacccaagcaaaagttcagcgaggacctggaatcttataaaattagcgtggtgatgcaagaaagcgcagagaaactgtcagaaaagctccataaatgcaaagagtttgtggactcttgccggctcacctttcctacatcgggcgacgaatactcacggggattcttacagaatctgaaccttatacaggatcagaacgctcaaactagatggaagcaggggcgttacgatgaagatggtaaacctttcaaccaacgcagcttgctgctgggccatgaaagaatactgacccgagcaaagtcatacgagtgctctgaatgtggtaaggtgatcagacgcaaagcttggtttgaccaacatcagcgtattcatttccttgagaatcccttcgaatgtaaggtgtgtggccaagccttccgccagcgttccgctctcactgtacacaaacagtgtcacctgcagaacaaaccttaccgctgccacgactgtggaaagtgtttccgtcagctggcttatttggtcgagcacaagaggattcataccaaggagaagccttacaagtgtagtaagtgcgaaaagacgttcagtcagaatagtacgctcatcaggcatcaggtgattcactccggcgaaaagagacataagtgtttagagtgcgggaaagcattcggcaggcattctaccttgttatgtcaccagcagatccatagtaaacccaatacacacaagtgctctgaatgcgggcaaagtttcggcagaaatgtggacctgatccagcaccagcggattcacaccaaggaggaatttttccagtgcggcgaatgtggtaagacatttagttttaagaggaatttgttccgacatcaggtgatccatacaggcagtcaaccataccagtgtgtcatctgtggaaagagttttaagtggcacaccagcttcatcaagcatcagggtacacataaaggccagatttccacctag

SEQ ID NO: 25866 - DNA, 189 bp, Artificial Sequence
  Description of Artificial Sequence: Synthetic coding sequence
atgttccctcccgctaggggaaaggaactgctgtcgttcgaagacgttgctatgtattttacccgtgaggagtggggccacctgaattgggggcagaaagacctgtatcgcgacgtcatgctcgaaaattatcgtaatatggtgttactggtgtatttccagttcgatgcagcaatccccctgtgttag

SEQ ID NO: 25867 - DNA, 1911 bp, Artificial Sequence
  Description of Artificial Sequence: Synthetic coding sequence
atggctcacctgatgatgttccgcgatgtggccgtcgacttttcccaggaggagtgggagtgcctcgatctcgaacagagggacttgtaccgtgatgttatgctcgagaattattctaatatggtcagcttagggttctgcatttatcagccagaggcgttcagcttgttggaaaaagggaaagagccctggaaaatcctcagagatgagacccgaggtccatgtcccgacatgcagtcacgatgtcagacgaagaagctcttgcccaagaatggcatctttgagcgggaaatcgcacagctcgagatcatgaggatatgcaagaatcatagcttagactgcctgtgttttcgcggtgactgggaagggaacactcaatttcaaacgcttcaggacaatcaggaggagtgctttaagcaggtgatccgcacatgtgagaagcgcccaacctttaaccagcataccgtgttcaaccttcaccaaaggctgaacaccggtgacaagctgaacgagttcaaagaacttgggaaagccttcatatccggaagtgatcacacccagcaccaattaatccatacaagtgagaaattttgtggtgacaaggaatgtgggaatacatttctaccggattctgaggtcatccagtaccaaacggttcatacagttaagaagacctacgagtgtaaggagtgtggtaaatcgttcagcctgcgaagctctctcaccggccataaacggatccacacaggcgagaaacccttcaaatgtaaggactgcggcaaggcatttagattccatagccaactgagcgtacataagagaatccacactggtgaaaaatcatatgagtgcaaggaatgtggcaaggcttttagttgcggcagcgacctcaccagacatcagcggatacacacaggcgaaaaaccctatgaatgcaatgaatgcagaaaggccttctcacaacggtcccaccttatcaaacatcagcgcatccacacaggagagaagccttacgagtgcaaggaatgtggcaaggcattcacaagaggcagccatctgacccagcaccagcggatccatacaggagaaaagagtcacgagtgtaaagagtgcggaaaagcattcatccgcggatcgaaccttgcccaacatcagaatgtgcacgtgggcaggaagccctacaagtgtgaaaaatgcggcaaggcctatatctggagtagccaccttgctcgccaccagagaatccatactggtaggaagccctacgagtgcaaacagtgtggcaaaacctttacatgggcctcctatctggcccaacacgagaaaattcataacgagaggaagtcttacgaatgcaaagagtgcggaaaaacgttcctgcacgggtccgaattcaatcgccaccagaaaatccacacgggtgagaggaattacgagtgtaaagagtgtggcaagactttctttcgcggatcagagttgaacagacatcagaagatccatactgggaagcgtccctacgagtgcgaggaatgtggtaaggcgttcctgtggggaagccaactgaccagacaccagcgcatgcataccggggaggaaccttacgtgtgtaaagaatgtggtaaatcattcatttggggctcgcaattgacccggcataagaagattcatacagatgcagaaccatacggctgcaagaaaagcagccatattttttctcaccactcatactttacggagcaaaaaattcataacagcgcaaacctctgcgaatggaccgattacgggaatacattttcgcatgagagtaattttgcgcaacatcagaatatttatacgtttgagaagagttacgaattcaaagactttgagaaggctttctcctccagctcccatttcataagtcttctttag

SEQ ID NO: 25868 - DNA, 408 bp, Artificial Sequence
  Description of Artificial Sequence: Synthetic coding sequence
atggcacatctcatgatgtttagagacgtcgcagtagatttctctcaggaggaatgggaatgtttggacctggagcagagagacctttacagagatgttatgctggaaaattatagtaacatggtaagtctgggattctgcatttaccaaccagaagccttttcattacttgagaagggcaaagagccctggaagattctaagggatgagacccggggtccgtgtccagatatgcagtctcgttgccagactaagaaactcttacccaaaaacggcatattcgagcgtgaaatcgctcagctggagataatgcggatctgcaagaatcactctctcgactgtttgtgctttaggggagattgggagggcaacacgcagtttcagaccctccaggacaaccaagaatag

SEQ ID NO: 25869 - DNA, 150 bp, Artificial Sequence
  Description of Artificial Sequence: Synthetic coding sequence
atggctcacctcatgatgtttcgcgacgtggccgtcgacttttcacaggaggaatgggagtgcctggatctggaacagagggacttatacagagatgtcatgctggaaaattactctaacatggtgtcattgggcttctgcatttactag

SEQ ID NO: 25870 - DNA, 540 bp, Artificial Sequence
  Description of Artificial Sequence: Synthetic coding sequence
atggctcatcttatgatgtttcgtgacgtggctgttgacttctcccaggaggagtgggaatgcctagatctcgagcaaagggacctgtatcgggacgtgatgctggaaaattactccaacatggtgagcctcggcttctgcatctaccaacctgaggcgtttagcctactcgagaaggggaaggagccatggaagattcttcgcgatgaaacacgcggaccgtgccccgatatgcaatcgaggtgtcagaccaagaaacttctgccgaagaacggcatttttgagagagagattgcccagcttgagataatgcgtatatgtaagaaccatagcttagactgcctttgttttcgaggcgactgggagggtaacacacagttccagaccctgcaggacaaccaagaggagtgcttcaagcaggtgattcgcacctgcgagaagcggcctacattcaatcagcacaccgtcttcaacctgcaccagcgcctcaataccggcgataagcttaacgagttcaaggagctaggcaaggctttttag

SEQ ID NO: 25871 - DNA, 1731 bp, Artificial Sequence
  Description of Artificial Sequence: Synthetic coding sequence
atggattccgtcgccttcgaggatgtgtctgtgagtttttctcaggaagagtgggctttgcttgcacctagccagaagaagctttaccgggatgttatgcaggagacgttcaagaatctcgcgagcattggcgaaaagtgggaggaccccaatgtcgaagatcagcacaagaatcagggaaggaatctaaggtctcacactggggagcggctctgtgaagggaaagaggggtcccaatgtgcagagaacttcagtcccaatttgtctgtcacaaaaaaaactgcgggagtgaaaccgtacgagtgcacaatctgcggcaaagccttcatgaggctgagcagtctcactaggcatatgcggtcgcacaccggctatgagctcttcgaaaaaccctataagtgtaaagagtgtgagaaggctttcagttacctcaagagcttccaaagacacgagcggagccataccggggagaagccctataagtgcaagcagtgtgggaagaccttcatttatcatcaacctttccagcgccatgaacggactcacatcggagagaagccatacgagtgtaagcagtgcggtaaagcgctgagttgttcttcctctctacgggtgcacgaaagaatccacaccggcgagaaaccatatgaatgtaaacagtgcgggaaagcctttagctgcagctcatcaattagggtgcacgagagaacccataccggagagaagccctatgcctgtaaggagtgcggaaaggcattcatctctcatacaagcgtcctcacacacatgatcacacataatggcgaccggccatataaatgcaaggaatgcggcaaggcattcatctttcctagttttcttcgcgtgcatgaaagaattcatacaggcgagaaaccatataagtgcaaacagtgtgggaaggcctttagatgttccacgtctattcagattcacgaaagaattcacaccggcgaaaaaccatataagtgtaaggagtgcggcaagagcttctcagcccgtcccgcattcagagttcacgttcgggtacacacgggagaaaaaccatataagtgcaaggaatgcgggaaagcctttagccgaataagttatttcagaatacacgaacggacccacactggtgaaaaaccatatgaatgcaaaaaatgcggcaaaacatttaattacccactggacctcaagatccacaagcgaaatcacacaggggaaaagccctacgaatgtaaggaatgcgctaaaacctttatttctctcgaaaattttcgacgccacatgataacacatactggagatggtccatacaagtgtcgcgattgtggcaaggtcttcattttccccagcgccctccgtacccacgaacggacacatactggagagaagccgtatgaatgcaaacagtgcggcaaggctttctcttgtagctcatatatccggatacataaacgaacacatacaggtgagaaaccttacgagtgtaaagagtgtggtaaggcttttatttaccctacgtcctttcaagggcatatgcgtatgcacacaggagagaaaccctataagtgtaaagagtgcggcaaagcttttagcttacatagtagcttccagcgccacacgcggatccacaactatgaaaaacctcttgagtgtaagcagtgcggcaaggccttttccgttagcaccagtctcaagaagcatatgagaatgcacaaccgttag

SEQ ID NO: 25872 - DNA, 1434 bp, Artificial Sequence
  Description of Artificial Sequence: Synthetic coding sequence
atggacagtgtagccttcgaagatgtaagcgtctctttttctcaggaggagtgggctttactcgcccctagccagaaaaagctctatcgcgatgtgatgcaggagacattcaagaacctggcaagtattggcgagaaatgggaagatccgaacgtggaggaccagcataagaaccaaggcaggaacctaaggagtcatactggggaacggctctgcgaaggaaaggagggaagccagtgtgctgaaaatttctccccaaatctttcagtgactaagaaaacagcaggggtcaaaccttatgaatgcacaatctgcggaaaggcctttatgaggttgagctctctcacacgtcacatgcgaagtcacactggctatgagctcttcgagaaaccatataagtgtaaagagagcggtgagaaaccttacaagtgtaaacagtgtgggaagactttcatttatcaccagccatttcagcgtcacgaaaggacccacatcggcgagaagccctatgaatgtaagcagtgcggaaaggcactgagttgcagcagctctctgcgggttcacgaacggatacacactggggaaaaaccttacgagtgtaaacagtgtggcaaagcattttcatgtagtagttctatacgcgttcatgaacgaacacacactggcgaaaagccctatgcgtgtaaggagtgcggcaaagcttttattagtcatacttcagttctgacacacatgatcacacataacggcgatagaccttataagtgcaaggagtgcggcaaggctttcatcttcccctcatttctgcgagttcatgaacggatacacactggggaaaaaccttataaatgcaagcagtgcgggaaagcctttcgttgtagcacaagcatccaaattcatgagcggattcacaccggcgaaaaaccttataaatgtaaagaatgcggaaagagtttctccgctcggcctgcatttcgggtacacgtgcgggttcacactggagaaaaaccgtacaagtgcaaggaatgtggtaaagcattcagcagaattagttactttagaattcatgaaagaacccacaccggagaaaagccgtacgagtgcaaaaagtgcggaaaaacttttaactatcccctcgatctaaagatccacaaacgcaatcacaccggagaaaaaccttatgagtgtaaggactgcggcaaggtattcatttttccgtccgccctgcggacccatgagcgaacccacacaggagaaaaaccttacgagtgtaagcagtgtggcaaggcgttctcctgttcttcttacattcggattcataagcggactcatactggagaaaaaccatacgagtgcaaggaatgtggcaaggccttcatttatcctacatctttccaaggccacatgcggatgcataccggcgaaaagccctag

SEQ ID NO: 25873 - DNA, 1635 bp, Artificial Sequence
  Description of Artificial Sequence: Synthetic coding sequence
atgcaggagacatttaaaaacctggcttctatcggagagaagtgggaagatcctaacgtcgaagaccagcacaagaaccagggccgaaaccttagaagtcacacaggagaaagactgtgtgagggcaaggagggcagtcagtgcgcagagaacttttcgcccaatctctccgtaacaaaaaagaccgccggagtcaaaccatacgaatgtactatctgcggtaaagctttcatgcggctgagttctcttacccgccatatgcgctctcacacaggatatgaacttttcgaaaagccctacaagtgtaaggaatgtgagaaggctttctcctatctgaaatctttccaacgccacgaaaggagccatactggagaaaagccgtataaatgtaagcagtgcggcaagaccttcatctaccatcagccatttcagcgacatgaacgtacccatatcggggaaaagccatatgagtgtaaacagtgcggtaaggccctgagctgtagctctagcctgcgggtccatgaacgcatacacacaggagaaaaaccctatgagtgcaagcagtgcgggaaagctttcagctgtagcagtagcatacgcgtgcacgagcgcacccatactggtgaaaagccatacgcatgtaaagagtgtggcaaggccttcatctcccacacaagtgtactgacccatatgatcacacataatggtgacaggccctataaatgtaaagagtgcggaaaggcgttcatttttccatcatttctgagagtgcacgaacggatccacacaggggaaaagccatataaatgcaagcagtgtggcaaagcttttagatgcagtacatcgattcaaattcacgagagaattcatactggagagaaaccctataagtgcaaagaatgcgggaagagcttcagcgcccgacccgcattcagagtacacgtgcgggtgcacaccggagaaaaaccttataaatgtaaggagtgtggtaaggcattttcacggatcagctacttccggattcacgaacgaacacatactggggagaagccttatgagtgcaaaaagtgcgggaagactttcaactacccccttgacctcaaaattcacaagaggaatcacacaggggaaaaaccctacgagtgtaaggaatgtgcaaagaccttcatcagcctggaaaattttcggcgtcatatgatcactcacaccggtgatggcccttataagtgtcgtgactgtggaaaagtattcatcttccccagtgctctcagaacccatgagcgcacgcacaccggggaaaaaccttacgagtgtaaacagtgcgggaaggctttcagctgctctagctacatccggatacacaagcgcacacatactggggaaaagccctatgaatgtaaggaatgtgggaaggcatttatctatcctacgagtttccaagggcacatgcgcatgcacacgggggaaaaaccttataaatgcaaggaatgcggcaaagctttcagcctgcatagttcatttcagaggcacacacggatccataactacgagaaacccctcgagtgcaagcagtgtggcaaggctttttcggtaagcaccagtctcaagaagcatatgagaatgcataacaggtag

SEQ ID NO: 25874 - DNA, 1404 bp, Artificial Sequence
  Description of Artificial Sequence: Synthetic coding sequence
atgcgactgagctcactgacgcgacacatgcgcagtcacaccgggtatgagttgtttgaaaagccatacaagtgcaaggaatgcgaaaaagctttcagctatcttaagtcatttcaacgccacgagagaagccataccggagagaaaccttataagtgtaaacagtgcggcaaaacctttatctatcaccagccattccagagacatgagcggacccacatcggggagaaaccttacgagtgtaaacagtgcggtaaagcgctctcatgctcctcaagtctgcgggtccacgaaagaatccacaccggtgaaaagccatatgagtgcaaacagtgtgggaaggccttcagctgcagctccagtatccgcgtacacgagcgaacccataccggcgagaagccgtacgcatgcaaagagtgcggaaaagctttcattagccacacatctgtgcttacccatatgataacgcataacggggacagaccttataagtgtaaagagtgtgggaaagcatttatattcccaagtttccttagggtgcacgagcgaatccacaccggagagaagccatataaatgcaaacaatgcgggaaagcctttagatgtagtacctcaattcagatccatgaaaggattcacaccggcgagaagccctataagtgcaaagagtgtgggaagagcttcagcgccagaccggcatttagagtgcacgtgcgtgtgcataccggagaaaaaccatacaagtgtaaagaatgtggaaaagccttttccaggatatcctatttcaggatccacgaaaggacccacacaggtgagaagccctacgagtgtaagaagtgtggtaaaacgtttaactatcccttggatttgaaaattcacaaacggaaccacaccggagagaagccctatgagtgcaaagaatgtgctaaaacttttattagcctggaaaactttcgtagacacatgattacacatactggagatggtccatacaaatgcagagattgtggtaaagtgtttatattcccgtctgcgttgagaacacatgagcgcactcacaccggagagaagccatacgagtgcaagcagtgcgggaaggcatttagctgcagctcttacatcagaatccataagcgcacgcacacaggggaaaagccatacgaatgtaaagagtgcgggaaagccttcatctatcctaccagttttcagggccatatgagaatgcacactggtgaaaagccttataagtgtaaggagtgtggtaaagcgttttctctacattcctcctttcagagacatacccggatccacaactatgagaagcctctggaatgcaaacagtgcggcaaggcgttctcagtttctacgtccttaaaaaagcacatgcggatgcacaacagatag

SEQ ID NO: 25875 - DNA, 1035 bp, Artificial Sequence
  Description of Artificial Sequence: Synthetic coding sequence
ttagcggagcatcagacgactcaccctaggcaaaagccttttgtctgtgaagagtcaggggacgcgtttaacaataagtcaacactggtccagcaccagcgaatccacagccgggagcggccttacgaatgtagcaagtgtggcatctttttcacttacgcagcagacctcacacaacaccagaaggtccataatagaggcaagccatatgaatgttgtgaatgcggaaaattttttagccagcactcctccctggttaaacacagacgtgttcacactggagaatctccccacgtatgtggagactgcggcaagtttttctcccggagtagcaacctcatacagcataaaagagtccacactggggagaaaccatacgagtgttccgattgtgggaagttcttttcccaaaggtctaatctcattcatcacaagcgagttcatacaggccgatccgcgcacgagtgttcagagtgcggaaagagctttaactgcaatagcagccttataaaacactggagggtacacaccggcgaaaggccctataagtgtaatgaatgcggaaagttttttagtcacatcgcaagtctgatacagcaccagatcgttcacaccggagagcgtccacacggctgtggcgagtgcgggaaagccttttctcgcagctcagacctgatgaagcaccagcgcgtgcacactggggaacggccatacgagtgcaacgaatgcggaaagttgtttagccaaagctctagcctcaactcccacaggcgtctgcacacaggtgagagaccgtaccagtgctctgagtgcggaaagttctttaatcaatctagcagtctgaataaccatcggagattacacacaggtgaaaggccatacgagtgcagcgaatgcggcaagactttccgacagagatctaacctgagacagcaccttaaggtccacaagcctgatcggccttacgagtgtagcgagtgcggaaaggccttcaatcagcgtccaacgctaatcagacatcaaaagatccactag

SEQ ID NO: 25876 - DNA, 1899 bp, Artificial Sequence
  Description of Artificial Sequence: Synthetic coding sequence
atggccgcagccgcattgcgcgacccagcccaggggtgcgtgacattcgaagatgtgacgatttacttcagtcaagaggaatgggtgctgctcgatgaagcccagaggctactgtattgcgatgtgatgctggagaattttgcgctcatcgcgtcgctcggcttaataagcttccgcagtcatatcgtgagccagctggagatgggcaaagagccctgggttccggactctgtagacatgacgagtgccatggctcgtggagcctatggacgtccgggatctgacttttgtcacggaacagaggggaaagacctccctagcgagcacaatgtgtccgtcgagggtgtagcccaagatcggtcccccgaggcgaccttgtgtcctcagaaaacctgcccctgtgatatctgtgggctccgtctgaaggatatcctccacttagccgaacaccagacaacgcatccacggcagaaaccttttgtgtgtgaggcttacgtcaaaggatctgaatttagcgctaacctgcccaggaagcaagtgcagcaaaatgtacataaccctattcgtactgaggaaggccaggcatcccccgtgaaaacgtgtagagaccacacctccgaccagcttagtacctgcagggaaggcggaaaagactttgtcgctactgcaggcttccttcagtgcgaagtcaccccttccgatggcgaaccccatgaagccaccgagggagtagtggactttcatatagcgctgcgccacaataagtgctgtgagagcggcgatgctttcaacaacaagagcacactcgtgcaacaccagcgcattcacagtagagagaggccttacgagtgcagtaagtgtggaatttttttcacctacgccgctgaccttacccaacatcagaaggtccacaacaggggcaaaccttatgaatgttgcgagtgtggaaagttcttttcacaacacagcagcctcgttaaacataggagggtgcacacaggcgaaagtcctcacgtatgtggcgactgtggtaagttcttcagtcgctcatccaatctcatccagcacaagagagtccatacaggtgagaaaccttacgaatgctcagactgtggcaagttctttagccagagaagcaacctcatccaccacaaacgtgttcatacaggcagaagtgctcacgagtgttccgaatgtggtaagtctttcaactgtaactcaagtctgatcaagcactggagagtgcacaccggcgagcgaccgtacaagtgtaatgaatgtggcaagttcttctcccatatcgcctctcttattcagcaccaaatagtgcacaccggggaacggccacacggatgcggagaatgtgggaaagcattcagcaggagtagtgaccttatgaagcatcagagagtccacactggtgagagaccatacgagtgcaatgaatgcggaaagctgttctcccagtccagctcccttaacagtcaccggaggttgcacaccggggagcgcccttaccaatgttctgagtgcggtaagttcttcaatcagtcgagcagtcttaataaccatcggagactccataccggagagcgaccatatgagtgctcagagtgcggtaaaacattcagacagaggagtaacctgagacagcacctcaaagtgcataagcctgataggccgtacgaatgcagcgagtgcggcaaagccttcaaccaaaggcctacactgatccgccaccaaaaaatacatatccgcgaaaggtcaatggagaatgtgctgctgccttgttcccagcacacgcctgagatctcatctgaaaatcgcccataccaaggtgccgtcaattacaagctgaagcttgtgcacccaagcacccacccaggggaggttccttag

SEQ ID NO: 25877 - DNA, 1836 bp, Artificial Sequence
  Description of Artificial Sequence: Synthetic coding sequence
atgcaggagacaattcgtaacttagattgcgtggggatgaagtggaaggatcagaatattgaagatcagtatcgctacccaaggaagaaccttaggtgtagaatgctggaacggttcgttgaaagcaaggacggcacccagtgcggcgaaacctcgtcccagatccaggattctattgtgacaaaaaatacattacccggagtgggcccttatgaaagccgcatgtctggagaagtgattatggggcattcttctctcaattgttatattagagtgggggcaggccataagccctatgagtaccacgagtgtggcgagaaacccgacacacacaagcaacgaggaaaagccttctcctatcacaatagccttcagacccacgagagactgcatactgggaagaagccgtacaactgcaaggagtgtggcaagtcctttagctccctggggaatctccagcggcacatggcagtccaacgcggtgacggaccttacaagtgcaagctatgtggtaaggcctttttttggccgtctcttctgcatatgcatgagcgtactcatacaggagaaaagccctacgaatgcaaacagtgttcgaaggcattttccttttattcgtcatatcttcgccacgaaagaactcacaccggcgagaagctgtacgagtgcaaacagtgttccaaggcatttccggactactcgagctgcctgagacacgaaaggactcataccgggaagaagccttacacctgtaaacagtgcggtaaagcattttctgcttcaactagtttgcgacgccacgaaacaacccacacggatgaaaagccctacgcatgtcagcagtgcggtaaagcatttcaccacctggggagttttcagaggcacatggtaatgcatacaagggacggccctcataagtgcaaaatttgcggcaaggggttcgactgtccttctagcctcaagtcccacgagcggacccacactggtgagaaactctacgagtgcaaacagtgtggtaaggcactgtcccattcctctagtttccgccgtcacatgacaatgcatactggggatggaccacacaagtgtaagatctgcggaaaggccttcgtctacccgtctgtgttccaacgtcacgaaaaaacgcacactgccgaaaaaccttacaaatgcaagcagtgcgggaaagcatacagaatcagctccagtctgcggaggcatgagacaacccacacgggcgagaagccgtataaatgtaagtgtgggaaagcatttatcgacttctattctttccaaaatcacaagactacgcacgccggtgaaaagccgtatgaatgcaaagaatgcggcaaggcattcagttgtttccaataccttagccagcatagacggactcacacaggtgagaagccatatgagtgcaatacatgtaagaaggccttcagccactttggaaacctcaaggtgcacgaacgcatccacagcggcgaaaagccctacgagtgtaaagagtgtggtaaggccttttcatggctgacatgcttcctgcgccacgaaaggatacacatgagagaaaagccctatgagtgccaacagtgcggcaaggcatttacccattcccggttcctccaaggtcatgaaaagacccataccggtgaaaacccctatgagtgcaaggaatgtggtaaagcattcgcctcactctccagcctccatcgccacaaaaagactcattggaaaaaaactcacaccggcgagaatccgtacggttgcaaggagtgcgggaaggcctttgcctctttgtcatcacttcaccgccacaagaaaacgcattag

SEQ ID NO: 25878 - DNA, 1932 bp, Artificial Sequence
  Description of Artificial Sequence: Synthetic coding sequence
atggcttcagtggcgcttgaggatgtggcagtaaactttactagagaggaatgggcacttcttggaccttgccagaagaacctctataaagatgtgatgcaagaaactattcgaaatctagattgcgtgggaatgaagtggaaggaccaaaacatagaagaccagtacaggtatccaagaaaaaatctgcgctgtagaatgctggaacggttcgtggagtccaaagacgggacccagtgcggtgagacctcaagtcagatacaagacagcattgtgacgaaaaacacactgccaggagtcggcccttatgagtctcgtatgagtggcgaggttattatgggccatagctctttgaactgttacatccgcgtgggcgctggtcataagccctacgagtatcatgaatgtggcgagaagcccgacacccataaacagcgcggaaaagctttttcgtatcataatagcctacagacacatgaaaggctccataccggaaaaaagccttacaattgtaaggaatgcggcaaatcatttagtagtctcggcaacctgcaacgccacatggcagttcagagaggcgacggcccttataagtgcaagttgtgcggtaaagcttttttctggccatccttattgcacatgcacgagaggacgcacacgggggagaagccctacgagtgcaaacagtgcagtaaagctttctccttctattcatcgtacctgagacacgaacgaacacacacaggagagaaactatacgagtgcaagcagtgcagtaaagcctttcctgactacagctcatgcctgcgtcacgaacggactcacactggcaagaaaccctacacgtgcaagcaatgtggcaaagcattttccgcctctaccagtctaaggaggcacgagaccactcataccgatgaaaagccatatgcttgtcagcagtgtggaaaggcgtttcatcatctgggcagttttcagcgtcacatggtgatgcatacccgggacggcccacacaagtgcaagatatgcgggaaagggtttgactgcccatcctctttgaaatcacatgagaggacccatactggcgagaagttgtatgagtgcaagcagtgtggcaaggcactgagtcatagttcctcgtttcgccgacatatgacgatgcatacaggcgacgggccacataagtgcaaaatctgtgggaaagcattcgtttatccttccgtatttcagcggcacgagaaaactcataccgccgaaaagccctacaagtgcaagcagtgcgggaaggcataccgaatctcttcttctttgcgccgacatgagaccacccatacaggggagaagccctataagtgtaagtgcggcaaagctttcattgatttttatagcttccagaaccataaaactacccacgctggcgagaaaccatacgaatgcaaggagtgtggcaaggcgttctcatgttttcagtatttgagccagcacagaaggactcacacaggtgaaaaaccatacgagtgcaatacgtgcaagaaggctttctcgcacttcggcaacctcaaggtccacgagcggatccatagtggcgagaagccctatgagtgtaaggaatgtgggaaagcgttctcctggctgacctgcttcctgagacacgagagaatccacatgcgtgagaagccttacgagtgtcaacagtgtggaaaggcgttcacacactcccggttccttcaagggcatgagaaaacccacacgggcgagaacccgtatgagtgtaaggaatgcggcaaggccttcgcgtccctgtcgtctctgcacagacacaaaaagacgcactggaagaaaacacatacaggcgagaacccctacgggtgcaaggaatgcggaaaagcattcgctagcctgtcaagccttcacagacataagaagactcactag

SEQ ID NO: 25879 - DNA, 1995 bp, Artificial Sequence
  Description of Artificial Sequence: Synthetic coding sequence
atgccacttcgcgataagtactgccaaactgatcaccaccaccacggctgctgcgagccagtgtatattctagagccaggcgatccgccactgctacagcagccgctgcagacgagcaagagtgggattcagcagatcatcgagtgttttaggagcggaacaaagcagctaaagcacatcctgctcaaggatgttgacaccatctttgagtgcaaattgtgcaggtcactctttagaggactgcccaacttaatcacccacaagaagttttactgtccccctagtctccagatggatgacaacctgcctgatgtaaatgataaacagagtcaggcgataaatgacctgctggaggctatctatccaagtgtggacaaaagagaatacattattaaactggaacccatagaaactaaccagaacgcagtattccagtatatcagcaggacggacaatccaatcgaggtcaccgagagctctagtactcccgagcagactgaggtgcagatacaggaaacatcgacggagcagtctaaaactgttccggtgactgacacagaggttgaaacagttgaaccgccaccagtggaaatcgtcaccgacgaggttgccccaaccagcgatgagcagcctcaggaaagccaagcggatctggagacatccgataatagtgattttggacaccagctgatttgttgtctgtgccgcaaggagtttaacagtaggcggggagtgagaaggcatattaggaaggtccacaagaagaagatggaagaattgaagaaatacattgaaacacgcaaaaacccaaaccagtcaagcaagggcaggagcaagaacgttctcgtgccccttagccgctcttgccctgtttgttgcaagagttttgcaaccaaagccaacgtgcgcagacattttgatgaagtgcacagaggcctaaggcgtgactccattactcctgacatcgccacaaagcccggacagcctctgttcttggactccatcagtcctaagaaaagtttcaagaccaggaagcaaaaaagctccagcaaggccgaatacaatctgaccgcttgcaagtgcctgttgtgtaagagaaagtactcatcgcaaataatgctcaagcggcacatgcagattgtccacaaaatcacgctctccggaacgaactccaagcgcgagaaggggcctaacaatacggcaaattctagtgaaattaaggtgaaagtggaaccggctgatagcgtcgagtcctctccaccctcaatcactcattcaccacaaaatgagctgaaaggcacgaaccattcaaacgagaagaaaaacacacccgctgcccagaagaataaggtgaaacaggatagcgaaagccccaaatctaccagtcccagtgccgctggcggacagcaaaagaccaggaagcctaagttgtccgctggattcgacttcaagcagttgtactgcaagttgtgtaaaagacagtttacatccaagcagaatcttacaaagcacatcgagctgcatacagatggaaataatatctacgtgaaattctacaagtgccccctgtgcacttacgaaaccagaaggaaaagggatgtaatcagacacattacagtagtgcacaagaaatcgagccgatatctgggcaaaatcaccgccagtttagaaataagggcaataaagaagccaatagatttcgtgctgaacaaggtggctaagcggggacccagccgcgacgaagctaagcattcagactccaagcatgacggaactagcaattcaccgagtaaaaagtacgaggtcgcagatgtaggtatagaggtcaaggtgaccaagaacttttcactccaccgatgcaataagtgcggcaaggcattcgccaaaaaaacctatttagagcatcataagaagactcataaggcgaatgcatctaactcacctgaaggcaataaaaccaaaggcaggtcgacgagatctaaagccttagtatag

SEQ ID NO: 25880 - DNA, 1995 bp, Artificial Sequence
  Description of Artificial Sequence: Synthetic coding sequence
atgcctctgcgggacaaatactgtcagaccgatcaccatcatcatgggtgctgcgaaccagtctacattctagagcctggtgatccgccactactgcaacagccattgcagactagtaaaagcgggatccagcagataattgagtgctttcggtccggaacaaagcagctcaaacatatacttctgaaggacgtggacactattttcgaatgcaaactttgccggagtttgtttcggggactgcccaacctgatcacccacaagaaattctactgtccaccatctctgcaaatggacgataatctgcccgatgtgaacgacaaacaatcacaagcaatcaatgatctgctggaggcaatttaccccagcgtggacaagagagaatatattatcaaacttgaaccaatcgagacaaaccagaatgcagtgttccagtatatatctagaaccgataatccaatagaggtgacagagtcctcctcgacgccagagcagacggaagtccaaattcaggagacctctacagagcaatccaaaactgtaccagtgacagacacagaagtggagacagtggagcctccgcctgttgaaatcgtcaccgacgaagtggctccaacatccgacgaacagccgcaggagagtcaggctgacctggaaaccagtgacaactccgattttgggcatcagctgatttgctgcctctgccggaaggaatttaatagccggagaggggtgaggagacatatcaggaaagtacataagaagaagatggaggagttgaagaagtatatcgagacccgtaaaaatcccaatcaaagctcgaaggggagaagcaaaaacgtgttggtcccgctatctcgctcctgccctgtttgctgcaaatcgttcgccactaaggcaaatgtgcgtaggcatttcgatgaggtgcaccgcggattgcgccgtgattctattaccccggacattgctactaagccaggccagcccttatttttggacagcatttctccaaagaaaagttttaagactaggaaacagaagtccagcagtaaagctgaatacaatttgaccgcatgtaaatgtcttctgtgcaaacggaaatattcatcacagattatgctgaaaaggcacatgcagatcgtacataaaattaccttaagcggcactaatagtaagcgggagaaagggcctaacaacactgctaactcctctgagattaaggtgaaagttgaacctgccgactcggttgagtcaagccctccgagtatcacccattcgcctcagaacgaactgaagggaactaaccacagtaacgaaaagaaaaatacccccgctgcacagaagaataaagtgaaacaagacagtgaatcccctaaatccaccagcccttcagcggctggaggccagcaaaagacgcgaaagcctaagctctcagctggattcgacttcaaacagttatattgcaaactctgtaagcggcaattcacttcaaagcagaacttgacaaagcacatcgaattacacaccgatggtaacaacatttatgtgaagttctacaagtgcccgctctgtacatacgagacccgaaggaagagggacgtgattcggcatataactgtggtccacaagaaatctagtcggtatttgggcaagattaccgctagcctggaaatccgagcaatcaaaaaacctattgattttgtgcttaacaaagtggctaaacgtggtccaagcagggacgaggccaaacatagcgacagcaagcacgatggcacttcaaatagcccatcaaagaaatacgaggtggcggatgtcggcatcgaggttaaagttaccaaaaactttagcctgcaccgttgcaacaagtgcggcaaggcctttgcaaaaaaaacctacctcgagcaccataaaaagacccacaaggctaatgcctccaactcaccggagggaaacaaaactaagggtcgctccactcgatccaaggccctagtatag

SEQ ID NO: 25881 - DNA, 1995 bp, Artificial Sequence
  Description of Artificial Sequence: Synthetic coding sequence
atgcctctgagggataagtactgccaaaccgatcaccatcatcatggctgctgcgagcccgtgtatatcctggagcctggagatcccccactgctgcaacagccactgcaaaccagtaagtccgggatccaacagatcattgaatgtttcagatccggaaccaagcagctcaaacacatccttctgaaagacgtggacacgatttttgagtgcaagttgtgcagatctctgtttcgaggcctgcctaacctgatcacccacaaaaagttttattgtccaccctcattgcaaatggacgataatctcccggatgtgaatgacaagcagagccaagccattaacgacctcctagaagctatctatccgtccgtggataagagagaatacataattaaactggagccgatcgaaacaaaccagaatgccgtgttccagtacatcagcagaaccgacaatccaatcgaggtgactgagagctcaagcaccccggaacagactgaagtccagatccaggaaacaagtaccgaacagtccaagacggtgccagtgactgatacagaggttgagacggtcgagccgccaccagtagagatcgtgaccgacgaagttgcgcctacttctgacgaacagccccaggaatctcaagccgacctcgagacatccgacaattctgatttcggacaccaactcatttgttgtctttgcagaaaagaattcaattctaggcggggagtgcgaaggcatatcagaaaggtccacaaaaaaaagatggaagagttgaagaagtacattgagacaagaaaaaacccaaaccagagctcaaaggggagatctaagaacgtcttagtcccccttagtcggagctgcccagtctgttgcaaaagtttcgccacaaaggccaatgttaggcgtcactttgacgaggtccacagggggctgcgacgtgactccattacccccgatatcgccaccaagcccggacagccactttttttagactcgatcagccccaaaaagtcgttcaagacccgaaaacagaagagcagcagtaaagctgagtataatctgaccgcttgtaaatgcttactttgtaagcgtaaatattcatctcagataatgctaaagcgccacatgcagattgtgcataagatcactctttccgggacgaactccaagcgtgagaaggggccaaataacaccgcaaattccagtgagattaaggtgaaagttgaacccgcagactcagttgagtcctctccacctagtattacccatagtccccagaacgaactcaaaggcactaatcatagcaacgagaagaaaaatacaccggctgctcagaaaaataaagtgaagcaagattcggaatccccaaagtctacaagtcccagtgcagcgggagggcagcagaaaacaagaaagccaaagctttccgcagggtttgactttaaacagctttactgcaaactgtgtaagaggcagtttacatcaaagcagaacctgacaaaacatatcgagctacacactgacggcaataacatatacgtcaaattctacaagtgcccactctgtacctacgagacgagaaggaagcgtgatgtgatacgtcacataacggtcgtccacaagaaatcttcccggtacctggggaaaatcaccgcaagcctggaaattcgggctatcaaaaagccaatcgactttgtgctcaataaggtagccaagaggggcccttcaagggatgaagccaagcattcagatagcaaacatgacgggacttcaaattcaccatcgaaaaagtacgaggtcgcagatgttggtatagaggtgaaggttacaaagaatttcagtctccacaggtgcaacaaatgtggtaaggcatttgccaagaaaacgtacctggagcatcacaaaaaaacccacaaggcgaacgcgtccaacagtcctgaaggcaataagaccaagggacgaagcaccagatctaaggctctcgtgtag

SEQ ID NO: 25882 - DNA, 729 bp, Artificial Sequence
  Description of Artificial Sequence: Synthetic coding sequence
atgccactgagggataaatattgtcagacagaccaccatcatcacgggtgttgcgaaccagtgtatatattggagcctggggatccccctctcctccaacagcccctgcagaccagcaagtccggcatccagcagatcatcgagtgctttagatccggcactaagcagctgaaacatatcctgttgaaagacgtcgacaccattttcgagtgtaaactgtgtcggtcactgtttcgtgggctacccaaccttattacccataagaaattctactgcccgccatcgctgcaaatggatgataatctccccgatgtgaacgacaagcaaagccaggcaatcaacgacctgctggaggccatttatcctagtgttgataagcgagagtacattattaagttggagccaatcgagactaaccagaacgccgtgttccaatacattagtcgcacagataacccgattgaggtcaccgagtcgtcttctactccagagcagactgaggtgcagattcaagagacctccaccgagcaaagtaagacagtccccgtaacggacacagaggtcgagactgtcgagcccccacctgtagagattgtgacagacgaagttgcgccaacctccgatgagcagccacaggagtcacaagccgaccttgagacctcagataattctgactttggccaccagttaatttgttgtctctgtcgcaaagagtttaacagccgctag

SEQ ID NO: 25883 - DNA, 393 bp, Artificial Sequence
  Description of Artificial Sequence: Synthetic coding sequence
atgcctctgcgcgataagtattgtcagacagaccaccaccatcacggctgctgcgagcctgtttatattctggagccaggcgacccaccgttattacaacagcctctacagacctccaagtctggcattcagcagatcatcgaatgttttagaagcggcacaaagcaactgaagcacattctattaaaagacgttgatacaatatttgagtgtaaactgtgtaggtctctgttccgcggactgcccaacttgattacacacaaaaagttctactgtcctccgagtttgcagatggatgataacctgcctgatgtgaacgataaacagtcccaggcgatcaacgacttgttagaagcaatttacccttccgtcgacaaacgagaatatatatag

SEQ ID NO: 25884 - DNA, 297 bp, Artificial Sequence
  Description of Artificial Sequence: Synthetic coding sequence
atgcccctgcgcgacaaatactgccaaactgatcatcaccaccatggctgctgcgagcccgtttatattcttgaacctggcgatcccccactgttgcaacagcctctccagacctcaaagtcaggcattcagcagattattgaatgttttaggtctggtactaaacaactgaagcatatccttctgaaggacgtcgacaccattttcgagtgtaagttatgcagaagtcttttccgcggtctgcccaacttgattacacataaaaaattctactgccctccaagcctgcagatgtag

SEQ ID NO: 25885 - DNA, 1485 bp, Artificial Sequence
  Description of Artificial Sequence: Synthetic coding sequence
atgcagggtgaacgcctaagacctgggctcgactctcagaaggagaaactgccaggcaagatgtctcccaagcacgatggactgggaactgcggactccgtgtgtagccggattatccaggatagggtcagcctgggggatgatgtccatgactgcgactcacatggctcagggaaaaaccccgtcatccaggaagaagaaaatatttttaaatgcaatgagtgcgagaaggtgtttaataagaagcgattgctggctcgccatgaacggatccactccggcgttaaaccctatgagtgtaccgaatgtggaaaaactttcagcaagtcaacctacctgctccagcatcatatggtccacacaggggaaaagccatacaagtgcatggagtgcggcaaggcctttaacaggaagagtcatctgacacaacatcaaagaatacattccggcgaaaaaccttataaatgctctgaatgcggcaaggcttttactcataggagtacctttgtgctgcacaatagatctcacaccggcgagaaaccatttgtgtgtaaggaatgtggtaaagcattcagggatcgcccaggcttcattcgccattatattatccacagcggagaaaatccatacgaatgtttcgaatgcggcaaagtattcaagcacagaagttacctgatgtggcaccagcagacacacacaggggaaaagccttacgaatgcagcgaatgtggaaaggcgttctgcgaatcagccgctcttatacaccattacgtcatccacaccggggagaagccctttgagtgcctcgagtgtggtaaagcttttaatcatagaagctatctgaaaagacaccagcggattcatacaggcgagaaaccgtacgtctgctctgagtgcggaaaggccttcactcattgcagcacctttatccttcataaacgtgcccatacaggggaaaagccctttgaatgcaaagagtgtggcaaggccttctccaatcgggcagatcttatccggcacttctctatacacactggtgagaaaccatatgaatgcatggagtgtggaaaggcctttaatcggaggagcgggctgacccgccatcagaggatccactccggagagaagccgtatgaatgcatcgagtgcggcaaaacattttgctggtccaccaatctgattagacattctatcatccacaccggcgaaaaaccttatgagtgctccgaatgtggcaaggctttctcaaggtcctcatcgctgacacagcaccagcgcatgcacaccgggcgaaatcccatatcagttaccgatgtgggcaggccattcaccagcggccagaccagcgtcaatatccaggagttgctgctggggaaaaacttcctcaacgttacaacagaggaaaatttgcttcaggaagaagccagctacatggcctccgacagaacttatcagagggaaacgccccaggtgtcatccctttag

SEQ ID NO: 25886 - DNA, 1884 bp, Artificial Sequence
  Description of Artificial Sequence: Synthetic coding sequence
atggccatggccctgactgaccccgctcaagtgtcagttacatttgacgacgtggctgtgactttcacccaggaagaatggggccagttagacctcgctcaaagaaccctctaccaggaggtgatgctagagaattgtggcctccttgtgtccctaggctgccccgtccctcggcctgagctcatatatcacctggagcacggccaagagccctggacacggaaagaggacttgtcccaaggcacgtgtcccggagataaaggcaaacctaagagcactgaaccgactacgtgtgaactcgctttgagcgagggcatctcattttggggccagctgacacagggcgcatctggggattcccagctagggcaacccaaggatcaggatgggtttagcgagatgcagggcgagagattacggccaggactggattctcaaaaggagaaactgcctggcaagatgtcccccaaacatgacgggttggggactgccgattcagtatgtagcaggatcatccaagacagggtctctttgggtgacgatgtccatgattgtgactcccacggatctggtaagaatccagtaatacaggaggaggaaaacatatttaaatgtaacgaatgcgagaaggtgttcaacaagaagcggctgcttgcccgacatgaacggatccatagcggcgtcaagccttacgaatgtacagagtgtggcaagacgtttagtaaaagcacctaccttctccaacaccatatggtgcacaccggcgaaaaaccttacaaatgtatggagtgcgggaaagcctttaatcgtaagagccacctaacacagcatcagcgtattcattcaggagagaaaccatacaagtgcagtgaatgcggcaaggctttcactcaccgatcgaccttcgttctgcacaaccgctcccataccggcgagaaacctttcgtttgtaaagagtgcgggaaggcctttcgagacagaccagggttcattaggcactacattatccattctggtgagaacccctacgagtgcttcgaatgcggaaaagtattcaagcatcggagctacctgatgtggcaccagcagacacacaccggggaaaagccttacgaatgctcagagtgcgggaaggctttttgtgaaagcgcagcccttattcaccactatgtgattcataccggggagaagccattcgagtgcctggaatgtggtaaggctttcaaccatagaagctatctcaagcggcatcagcgcattcacacaggagaaaagccctatgtgtgtagcgagtgcggcaaagctttcacgcactgctctacttttattcttcataagagggctcacactggggagaaacccttcgagtgtaaggagtgtggaaaagctttttccaaccgggctgacttaatccgtcatttcagcatccacacaggagagaagccttacgaatgtatggaatgcgggaaagcatttaacagaaggagcggcctaacccgacatcagagaatacattctggagagaagccctacgagtgtatagaatgtgggaagacgttttgctggtctaccaatcttattagacacagcatcatccatacaggcgaaaaaccttacgagtgtagcgaatgcggaaaggccttcagccgatcatcaagcctaactcaacatcagcgcatgcatacgggccgtaaccccatatcagtgactgacgtcgggagaccattcacctccggacagacttccgtgaatattcaggagctgctgctgggcaaaaactttcttaacgtgaccacggaggaaaacttgctgcaggaggaagccagttatatggccagcgacagaacatatcaacgggaaacaccgcaggtcagtagtttgtag

SEQ ID NO: 25887 - DNA, 1485 bp, Artificial Sequence
  Description of Artificial Sequence: Synthetic coding sequence
atgcagggggagcggctgcggcctggtcttgactcccagaaggagaaactcccaggcaaaatgtctcctaaacatgatggcctcgggactgccgattctgtgtgcagtagaattatccaggatcgcgtgtccctgggtgatgacgtgcacgattgcgactcccacggcagcgggaaaaaccccgtgattcaggaggaggaaaacatcttcaagtgtaatgagtgcgagaaagtgtttaacaaaaaacgcttgctggctcgtcacgaacgcattcatagcggggtaaaaccctacgaatgcaccgagtgtggaaaaacattctctaaatctacttatctgctccagcatcacatggtccacactggcgaaaaaccctataagtgtatggaatgcggtaaagcgtttaacagaaagagccaccttacccaacatcagagaatccatagtggagaaaaaccatacaagtgctccgagtgtggcaaggcatttactcacagaagcacctttgtcctgcataacagaagtcacacaggagagaagccttttgtatgcaaggagtgcggcaaggccttcagggaccgacctggcttcattagacattacattatccatagtggagagaatccttacgagtgctttgagtgcggaaaagtgtttaagcataggtcctatctgatgtggcaccagcaaactcataccggagagaaaccttatgaatgtagcgagtgtggtaaggctttctgcgaaagcgctgccctaattcatcactatgtgatccacactggcgaaaagcccttcgaatgtctcgagtgtgggaaggcctttaaccacagaagctatttaaagcgccaccagaggatccatacgggagagaagccatatgtttgttccgagtgcggcaaggcatttactcactgcagtacgtttatcttgcataaacgggctcataccggagagaagccctttgagtgcaaggaatgcggaaaagccttcagtaaccgcgcagacctgattaggcacttttcaatacatacaggtgaaaaaccttacgagtgtatggagtgtggcaaagccttcaacagacggagcggtctcactagacaccagaggattcattccggcgaaaagccctacgagtgtattgagtgtggaaagacattctgttggtcgaccaatctcatcaggcactcaatcatacataccggggagaagccatacgagtgcagcgagtgcggtaaggctttttcgagatcttccagcctcacacaacaccaacgtatgcatacagggagaaaccctatcagcgtgactgatgtaggcagacctttcaccagtggccaaacttcggtgaacatccaagagcttcttttgggaaaaaacttcctgaacgtgacaaccgaagagaatctcctacaggaagaagcatcatatatggcttcagaccgtacttaccagcgggaaaccccacaggttagttctctgtag

SEQ ID NO: 25888 - DNA, 153 bp, Artificial Sequence
  Description of Artificial Sequence: Synthetic coding sequence
gccccattgcttagttgcatcactggggcaacgctggagacactgtgcgtgcaacgcgttaaagctttccgggatcgtccagggttcatacgccattacataatccacagtggagagaatccctacgagtgctttgagtgcggcaaggtctag

SEQ ID NO: 25889 - DNA, 2712 bp, Artificial Sequence
  Description of Artificial Sequence: Synthetic coding sequence
atgctcagggaggaggccgctcagaagaggaaagggaaggaatcaggtatggccttgcctcagggtcggctgacattccgcgatgtggctatcgagttcagtctggcagagtggaaattcttgaatccagcccagagggctctctatcgcgaggtgatgctggagaactacaggaaccttgaggcggttgatatatcctctaaacacatgatgaaagaggtactttccacagggcagggtaatcgtgaggttattcacaccgggactctgcagagacaccagtcataccacataggcgatttctgtttccaggaaattgaaaaggagatccacaatatagaattccagtgtcaggaagacgaacgcaacggccacgaagcacctaccacgaagatcaaaaagctgacagggagcaccgatcaacatgaccataggcatgctggcaacaagcccataaaggaccagctgggcagcagcttctatagccacttgcccgagctccatatttttcagataaaaggtgagattgcaaaccaattggaaaagtctactagtgacgcatcctctgtttccacatctcaaagaattagttgtcgccctcaaattcacatcagtaacaactacgggaataaccccctgaatagcagtcttctgccgcagaaacaggaggtgcatatgagagagaagtctttcccatgtaacgagtcaggcaaggcattcaactgcagctcactgctgcgtaagcatcagatcccccatctaggcgataaacaatacaaatgcgatgtgtgcggcaaactgtttaaccacaaacagtatcttgcatgtcaccggcgttgccatactggagaaaagccatataagtgtaaagaatgtggcaaatcattttcatataagagcagtctgacctgccaccatcgactccacaccggcgtgaagccgtacaaatgcaatgaatgcggtaaggtgtttcgtcagaattcggctctggtcattcataaggctattcataccggggaaaagccgtacaagtgcaacgagtgtggaaaggctttcaatcagcagtcacacctgtcacgccatcagcgtctgcataccggggtgaaaccctacaagtgtaagatatgtgaaaaggctttcgcatgccattcctacttggcgaatcacacacgtattcattccggtgaaaagacctacaagtgtaacgagtgtggcaaagcattcaaccatcagtcctctctggccagacaccacattctccacactggggaaaaaccttacaaatgcgaagagtgtgataaggtgttcagccaaaagagcacactggagagacataagcggattcatactggtgagaagccttataagtgtaaggtgtgcgatacggcatttacatgcaacagccagctggccaggcatagaaggattcatacgggcgagaagacttacaaatgtaacgagtgtaggaaaacgttttcccgaaggtcttctttgttgtgtcatcgcaggctgcactctggagagaagccctacaaatgtaatcagtgtggaaacacattcaggcaccgggctagcctggtctaccaccggaggctccacaccttagaaaaatcttacaagtgtacggtctgtaacaaagtgttcatgcggaactctgtgcttgcagttcacacccgaatccatacggccaagaaaccctataagtgcaacgagtgcggcaaagcatttaatcagcagtctcatctgtctcgccacagacggctgcataccggcgaaaagccatataagtgtgaagcttgtgacaaggttttcggccaaaagagcgcactcgagtcccataagagaatccatacaggtgagaagccttacagatgtcaggtctgcgacaccgccttcacctggaacagccagctggcacggcacacacggatccatacaggagaaaaaacatacaagtgcaacgagtgtggcaaaacgttcagttataagtcctccttggtctggcacaggaggctgcacggaggagagaaaagctataaatgtaaggtttgcgataaagccttcgtgtgtaggagctacgtcgcaaaacacacaagaatacactctggcatgaagccatataaatgcaacgaatgctcaaagaccttctctaacagatcatctctggtctgtcatcggcgtattcactcaggtgagaagccatacaaatgttcagagtgcagtaagaccttcagtcagaaagccacactgttgtgccataggaggttgcattccggggagaaaccctataagtgtaatgactgtggcaacactttcaggcactggtctagtctggtctaccatcggagactgcacacgggagaaaagtcctataagtgcacggtttgcgacaaggcctttgtaagaaactcatatttggccagacacattcgcattcataccgctgaaaaaccgtacaaatgcaacgagtgcggtaaagcattcaacgagcagtcccatctaagcagacatcacaggatacacacaggcgaaaagccctataaatgtgaggcatgtgacaaggtattctccagaaagtcacacctgaaacggcacaggatcatccacacgggcgagaagccatacaaatgcaacgaatgtggtaaagcttttagcgacaggagcacccttattcaccaccaggccatccatgggataggaaagtttgactag

SEQ ID NO: 25890 - DNA, 1854 bp, Artificial Sequence
  Description of Artificial Sequence: Synthetic coding sequence
atggcattgccgcaaggtttactaacctttcgtgacgtcgcaattgagttcagccaggaagaatggaaatgtctggacccggctcagagaacattgtacagggatgtgatgctcgagaattatcggaacctggtttctctggacatctcttccaagtgtatgatgaaggagttcagttcaacagctcaaggcaatagagaggtaattcatactggaactttgcagcggcacgaatcacaccatacaggagattttaggtttcaggaaattgataaagatatccacaatttagagttccagtggcaagaagacgagcgaaattctcatgaagcacccatgaccgaaataaagaaacttacaggaagcgcggacagatatgaccaacggcatgccggaaacaaacctatcaaggaccagcttggcagctctttccacagccatcttcctgagctgcatatgtttcagacgcagggaaagatcggcaatcaggtggaaaaatctattaatgacgcctctagtataagcacctcccagaggatcagctgccgccctaagacacatatatcaaacaactatggaaataatttcaggaacagctcacttcttactcagaagcaggaggtacatatgcgggagaaatccttccaatgtaatgagagtggcaaagcctttaactatagttccctgcttagaaaacaccaaatcatccacctgggcgagaagcagtataaatgcgacgtgtgcggcaaggtgtttaacaggaaaagaaacctcgtgtgccaccggagatgccacaccggggaaaagccctacagatgtaacgagtgtggcaagacctttagccaaacttactcgctgacatgccatcgccgactccatacaggcgagaagccttacaaatgcgaggaatgcgacaaagctttcagcttcaaatccaacttgaagcggcaccgccgtatccacgcaggagagaagccctacaagtgtaatgagtgtgggaagacgtttagccagacatcatccttgacgtgccaccgacgcctgcacacaggggaaaaaccgttcaaatgtaatgagtgcggcaagaccttctccaggaaaagctctctaacgtgtcaccacaggctccacaccggagagaaaccgtacaaatgcaacgagtgcgggaaaacattcagccaggagctcacattgaaatgtcacagacgccttcataccggggagaagccctataaatgtaacgagtgtggaaaggtgtttaacaaaaaggctaatctggccaggcatcaccgtcttcacagcggcgagaagccttataagtgcaccgaatgcgtcaaaaccttttctcgcaatagtgccctggttatccacaaggccatccatataggagaaaagcgttataaatgcaatgaatgtggaaagaccttctctagaattagtgcattagtaatacacaccgcaatccacaccggcgaaaaaccatacaagtgcaacgagtgcggcaaaggatttaacaggaagacacatcttgcctgtcatcataggcttcacaccggcgagaaaccttataagtgcaacgaatgtgggaaagtgttcaatagaaagacacacctggcacatcaccataggctacacaccggtgacaagccttataaatgtaatgagtgcggcaaggtcttcaaccaaaaagcccacctggccaggcatcaccggctgcacacaggcgagaagccatacaaatgcaatgaatgtggtaaggtgtttaaccagaaggcaaatttggcacgtcatcatcggcttcatacaggggagaaaccatataagttcaacgaatgtggaaaggccttcaactag

SEQ ID NO: 25891 - DNA, 183 bp, Artificial Sequence
  Description of Artificial Sequence: Synthetic coding sequence
atggctctgcctcaggggcttctcacgtttcgcgatgtggcaatcgaattttcacaggaagaatggaaatgtctagacccggctcagcgtacactttaccgagacgtcatgttagaaaattaccgcaatttggtgtctttagagctcagcggggagtgtcctcttgcggcacctgctagttag

SEQ ID NO: 25892 - DNA, 1956 bp, Artificial Sequence
  Description of Artificial Sequence: Synthetic coding sequence
atgctgagagaagaagccacaaagaagtcgaaagagaaagaacccggtatggccctgccccagggaagactgacattccgcgacgtggccattgagtttagcttagaggaatggaagtgtctgaatcccgcacaacgcgctctgtaccgagctgttatgctagaaaattatcggaatctagaattcgtggacagctccctgaaaagtatgatggagttctcctcaactagacattcaattactggagaggtgatccataccggcacactgcagagacataagtctcaccacattggcgatttttgtttccccgagatgaagaaagatatccatcattttgagttccagtggcaggaagtggaacgcaatggccacgaagcccctatgacgaagattaaaaagttgacgggcagcaccgaccggtcggaccatagacatgccggtaacaagccgatcaaggatcagctcgggctcagttttcacagtcatctgccggaactgcacatgttccaaacaaaagggaaaatcagtaaccagctggataagagtatcggggcttcatctgcgagcgaatcacaacgaatctcctgccggttgaaaacacacattagtaataaatatggcaaaaactttctgcacagcagtttcacacagatccaagaaatttgtatgcgtgaaaaaccttgtcagtccaacgagtgtgggaaggcgttcaattactctagtctcctccgaaggcaccacatcacacacagcagggaacgcgagtataagtgcgatgtgtgcggcaagatattcaaccagaaacagtacattgtgtatcaccaccggtgtcacacaggagagaaaacgtataagtgtaacgaatgtggcaaaacttttactcagatgagctcacttgtctgccacagacgcttgcatacaggcgagaagccatataagtgcaacgagtgtggtaaaaccttctccgaaaagtctagtcttcgctgtcataggcggctgcacactggagagaaaccctataaatgcaacgagtgtggcaaaacatttggacgcaacagcgcacttgtgattcataaagcgattcacactggcgagaagccttataagtgcaatgagtgcggtaaaacattcagccagaagtccagtttacagtgtcaccacatactccatacaggcgagaagccttacaagtgtgaagagtgtgataatgtatatatccggaggagccatctcgagcgtcaccgcaaaatccacaccggagagggctcatacaaatgcaaagtctgcgacaaggtctttaggtctgactcctatttggccgagcatcagagggtgcatacaggagaaaaaccctataaatgtaacaagtgtggtcgctccttctcaagaaagagctcgctgcagtatcatcatacacttcacacaggggaaaagccttacacttgcaacgaatgcgggaaagtgttcagccgccgagaaaatttagccaggcatcatcgcctgcacgccggagagaagccttataaatgcgaggaatgtgataaggtcttctctcgcagatcccatctggagcgccaccggcgaatacataccggcgaaaagccatataaatgcaaagtctgtgacaaagctttccggagcgatagctgtttggcaaaccacaccagggtgcacactggcgagaaaccctataagtgtaacaagtgcgccaaggttttcaatcagaaaggcatccttgcccagcaccagcgtgtgcacacaggggaaaaaccatacaagtgcaacgagtgcggcaaggtctttaatcagaaggccagcctggccaaacatcaaagggtccacaccgctgagaagccctataagtgtaatgagtgcgggaaggcctttactgggcagagcacactcatccatcaccaggccatccacggttgccgtgaaacattgcagatgtag

SEQ ID NO: 25893 - DNA, 702 bp, Artificial Sequence
  Description of Artificial Sequence: Synthetic coding sequence
atgcttcgtgaggaggcgacgaaaaaatccaaagaaaaagaacctggcatggctttaccacagggtaggttgacattcagggatgtggccattgagtttagcctagaggagtggaaatgtctgaacccggcacaaagagcattgtatcgggctgtcatgcttgaaaactatcgcaacttggaatttgtggatatcagttccaagtgcatgatgaaagaattctcctctaccgctcaaggcaataccgaggttattcacacagggacactccagcgtcatgagagccaccacatcagagatttctgtttccaggagatagaaaaggacattcataattttgagttccagtggcaggaggaagaaagaaatgggcacgaagcccctatgacagaaatcaaagaactgacggggtcaactgataggcacgaccagagacatgccggtaacaagccaatcaaggaccagttgggatcatcctttcacagccatcttcctgaactccacatcttccagccggagtggaaaatcggtaaccaggtagaaaagagtattattaacgccagcctgattctgacatctcaacgtataagttgctcacctaaaacaagaatttcgaataattatggcaacaattccttacattcctctctgccgatccagaagctgggtagcacacatgagcgtaaaattttcccaatgtag

SEQ ID NO: 25894 - DNA, 1956 bp, Artificial Sequence
  Description of Artificial Sequence: Synthetic coding sequence
atgctacgggaggaggctacgaaaaaatccaaggagaaggaacccggtatggctctgccacaggggagactaactttccgcgacgttgctatcgaatttagtctggaagagtggaagtgcctgaatccagctcagagagccctgtatagagccgtaatgctggaaaactacagaaatctcgagttcgtggacagctctctgaaaagtatgatggagttttcatctacccgacactcaattaccggggaggtaattcatacaggcaccctccagagacataagagccatcacattggcgacttttgttttccggagatgaagaaagacatccatcacttcgagttccaatggcaggaagtggagcgaaacggccacgaagctcccatgactaagattaaaaaactgactggctccacggaccgcagcgaccatcgacatgccggaaataaacccattaaggaccagcttggtctatcatttcatagccacttacccgagctccacatgttccaaaccaaaggcaagattagcaatcagctggataagtctattggcgctagcagcgcctcagaaagccagcgaatctcatgccgcctgaaaacccacatctccaataagtacggtaagaactttctccatagctcattcacccagatccaagaaatctgcatgcgggagaaaccctgccagtccaatgaatgcggaaaggctttcaattactccagcctcctgcggcgacatcatatcacacattcccgagaacgcgagtacaagtgtgacgtctgtggtaagatctttaatcagaagcaatatattgtgtaccaccataggtgtcatactggcgaaaagacctataagtgcaatgagtgtgggaaaacattcacccagatgtcaagcctggtatgtcataggcggctgcatacaggcgaaaagccctacaaatgcaacgagtgcggcaaaacttttagcgagaaaagttctctccggtgccatcgcagacttcacaccggtgagaaaccgtataagtgcaacgaatgcgggaagacctttggacgaaacagcgcactcgtgatacataaggccatccacaccggagaaaaaccctataagtgcaatgagtgcggcaagaccttctcccagaaatcctctctccaatgtcaccacatactccataccggggaaaaaccctacaaatgtgaggagtgcgataacgtttatatcaggcggagccatttggaacgtcaccgtaaaattcatacaggagaaggaagctataaatgtaaggtatgtgacaaggtgttccggtccgacagctatctcgctgagcaccaacgagttcataccggggaaaaaccgtacaaatgtaacaaatgcgggcgatcattctctcgtaagtcaagtctgcagtaccatcatacccttcacacaggcgagaaaccctacacttgtaatgaatgtggcaaagtcttttccagacgcgagaatctagccagacatcataggctccatgccggagagaagccgtacaaatgtgaggaatgtgacaaggtcttctcacgaagaagccatctcgagagacaccgtagaattcacactggcgagaagccatacaaatgcaaggtgtgtgataaagcttttcgctcagattcatgcctggctaatcacactcgcgtccacactggcgaaaaaccctataaatgcaacaaatgtgccaaggtgttcaaccaaaagggtattcttgcccagcaccagcgggttcataccggagaaaagccatacaaatgtaatgaatgcggtaaagtgttcaaccagaaggcatcgctggccaagcatcagcgcgtgcacacagcagagaaaccttacaagtgcaatgaatgcgggaaggcgttcaccggccaatccacgcttattcaccatcaagctatacacggatgcagagagacactgcagatgtag

SEQ ID NO: 25895 - DNA, 345 bp, Artificial Sequence
  Description of Artificial Sequence: Synthetic coding sequence
atgcttagggaggaagcgaccaaaaagtcgaaagagaaagagcccggaatggcgctcccccaggggcgtcttacatttagagatgtggctatcgagttcagcctagaagagtggaagtgtctgaaccccgctcagagggccctctatagggcggtgatgctggagaattatagaaacctggaattcgtagactcttcacttaagagcatgatggagttttcttccactcgtcacagtataaccggtgaagttattcatacagggacattacagaggcataagtcacaccatattggtgacttctgttttcccgaaatgaaaaaggatatccatcacttcgagtag

SEQ ID NO: 25896 - DNA, 495 bp, Artificial Sequence
  Description of Artificial Sequence: Synthetic coding sequence
atgatgaaagaattcagcagcaccgcccaaggaaacacagaggtaatccatacgggaacactgcagaggcatgagtctcatcacatcagagacttctgcttccaggaaattgagaaagacatccacaacttcgaattccaatggcaggaggaggagaggaacgggcacgaggcaccgatgacggaaattaaagagctgacgggcagcacggatagacacgaccagcgtcatgctggcaataaaccgatcaaggatcaactagggagcagctttcacagccatctgcctgaactacacatctttcagcccgaatggaaaatcggaaaccaagtcgagaaaagcatcattaacgccagcctcatcttgacaagccagcggatctcatgttccccaaaaacccgcatcagtaataattacggtaacaactcacttcatagctcacttcccattcagaagctggggtccacacatgaaaggaagatttttcccatgtag

SEQ ID NO: 25897 - DNA, 1599 bp, Artificial Sequence
  Description of Artificial Sequence: Synthetic coding sequence
atggcccttagaagcgtgatgttcagcgacgtgtctattgacttcagccctgaggaatgggaatacttggatctggagcagaaggacctttatcgcgacgtcatgctggaaaactacagcaacctggtgtcactcggatgtttcatctctaaaccggacgtaatttcaagcttagaacagggtaaggaaccctggaaggtcgttcggaagggaaggcgacagtacccggatctggaaaccaagtatgagacaaaaaagctgagtctggagaatgacatctacgagatcaacctgtcccaatggaagatcatggagaggattgaaaaccacgggttaaaaggcctaattttaaaaaatgattgggaaagcacaggtaaaatcgaagggcaggaaagaccccaggagggctacttctcttcagtgaagatgccatcagaaaaagtatcgagctatcaaaagcgtacatctgttacccctcaccagcgacttcatttcgtagataaaccctacgaatgcaaagagtgcggcaaagccttccgggtcaggcagcagctcacattccaccaccggattcatactggggaaaagccatacgaatgtaaggaatgtggcatggcctttcggcagaccgcgcatctcacacgccaccagaggctgcatagcggcgagaaattgtatgaatgtaaagagtgtggggaggcattcatctgcggcgcagatctccgagtgcaccagaagatgcatattggtgaaaagccttacgagtgtaaagaatgcggtaaggcatttcgcgtaagaggccagctgacgctgcatcagcggattcacaccggcgaaaagccctacgtgtgtaaagagtgcggcaaggcatttagacagtatgcccatctcaccaggcaccaaaaactgaattctgccgatagactgtatgagtgtaaggaatgtggaaaggcctttctgtgtgggagtgggttaagagtgcaccacaagctccacactggtgagaagccttacgagtgcaaagagtgcgggaaggcttttcgtgtccgccagcagttgaccctgcatcagcggatccatacaggcgaaaagccgtatgagtgtaaggagtgtggcaaaacgttcagcaggggctaccatctgatcctgcaccatcgaatacacacaggtgaaaaaccgtacgagtgtaaggagtgctggaaggcttttagccggtatagccagctgatatcccaccagtcgattcatatcggggtcaagccctacgattgtaaagagtgtggtaaggccttccgcctcctttcccagctgacccagcaccagagcatccacatcggagaaaaaccttataagtgcaaagagtgtggtaaggccttccggcttagacagaagctcactctacatcagagtatacacacaggagaaaagcccttcgagtgtaaggaatgcagaaaggcctttagactgaactcctcccttatccagcacctcaggatccactccggagagaagccatacgaatgtaaagaatgtaagaaagccttccggcagcattcccacctaacacatcatcttaagatccacaatgtgaagatttag

SEQ ID NO: 25898 - DNA, 1599 bp, Artificial Sequence
  Description of Artificial Sequence: Synthetic coding sequence
atggcattgaggtcggtcatgttttcagacgtgtctatagacttctctcctgaagaatgggaataccttgacctagaacagaaggatttatatcgagatgtgatgcttgaaaactacagcaacctggtgagtctcggtttactgttgctctccttcatttcaacactcgagatgttgctcctgctagttaaggaaaactctatgtgtctgctttcctgcttcatcctagatctcgagacgaagtacgagaccaagaaactgagcctggaaaacgacatctatgagatcaatctgtctcagtggaaaatcatggaacggatcgagaaccatggtctgaaagggctgatcctgaaaaacgactgggaaagcactggcaagatcgagggccaggaacgccctcaagaaggatatttttcttccgtgaaaatgcctagcgaaaaagtgagtagctaccagaagcgaacaagcgtgacccctcatcagaggctccacttcgtggataagccatacgaatgcaaagaatgcggcaaagctttccgggtgcgtcagcagctcactttccatcacagaatccataccggagaaaagccatacgaatgtaaagagtgcgggatggccttccgtcagacggcccatctcacacgccaccagcgtctacattctggggagaagctctacgaatgcaaggagtgcggagaagcgttcatttgtggagctgatctacgtgtgcatcaaaagatgcacatcggcgaaaaaccatatgagtgtaaggagtgcgggaaggcatttagggtcaggggccaactaactctccaccaacgcatacacactggagagaaaccgtacgtgtgcaaagaatgcgggaaagcctttagacagtatgcacatctgactagacaccagaagctcaacagcgccgaccggctctatgagtgtaaggaatgcggaaaagccttcttgtgtggtagtggtttacgagtgcatcacaaattacatactggggagaaaccgtacgagtgtaaagaatgtggtaaggccttcagagtgaggcaacagctgactcttcatcaaaggatccatacgggcgagaagccttacgagtgcaaggagtgcgggaaaaccttttccagaggctaccacctgatccttcaccaccgaattcatactggcgagaaaccttatgagtgtaaagaatgctggaaggccttcagtaggtactcacaactgatctcccaccagagtattcacattggagtaaaaccatacgactgcaaggaatgtggcaaggccttccgccttctctctcagttgacacagcaccagtcaatacacataggggagaagccctataagtgcaaggagtgtggaaaagcttttagactacggcagaaactgacactccatcagtcaattcacacgggagaaaagcctttcgagtgcaaggagtgccgaaaagcctttcgcctgaactctagtttgattcaacacctgcggattcattcgggagaaaaaccctacgaatgtaaggaatgcaagaaggcttttagacaacactcgcatctgacccaccacctcaagatccacaatgttaaaatctag

SEQ ID NO: 25899 - DNA, 1833 bp, Artificial Sequence
  Description of Artificial Sequence: Synthetic coding sequence
atggactcagtggctttcgaagatgtagccgttaatttcactcaagaagagtgggccctgctcggcccttcacaaaaatctctgtacaggaatgtgatgcaagaaaccatccgaaacctagactgcattgagatgaaatgggaagatcagaacataggagaccaatgtcaaaatgcaaaaaggaacttacgatcccacacgtgtgagatcaaagatgattcacagtgcggggaaaccttcgggcagatccccgatagcatcgtgaacaagaacacccctagagtgaacccgtgcgattcgggggaatgcggggaggtggttctgggccactcctccctaaactgtaatattcgggtcgatacaggacataagtcttgcgaacatcaggaatacggggagaagccgtatactcacaaacaaagggggaaagccattagccatcagcacagttttcaaacacacgagagaccccctacaggtaagaagccttttgattgcaaagagtgtgcgaagaccttctctagtctcggaaaccttcgacgccacatggcggctcaccatggcgacggcccatataaatgcaagctgtgtggtaaggccttcgtctggccatcactgtttcacctgcacgaaagaacacatactggggagaagccctatgagtgcaaacagtgtagtaaggcgtttccattttactcctcatacctacgccatgagagaatacatacaggagaaaaggcatatgaatgcaaacagtgttctaaagccttccctgactacagcacgtacctccgccacgagaggacacacacgggagagaagccctacaagtgtacccaatgcgggaaagccttcagctgctactattacactaggctgcacgaaaggacccacaccggcgaacagccatatgcctgtaaacagtgtggcaagaccttttaccaccacacctcctttcgcaggcacatgatcaggcacacgggagatggtccgcataagtgtaaaatctgtggaaaaggcttcgactgtccttcaagtgtgaggaaccacgaaacgacccacacaggtgagaagccatatgagtgcaagcagtgcgggaaggttctgagccacagctcttctttcagatcacatatgatcacccacacaggcgatgggccacaaaagtgcaaaatctgcgggaaggcgtttggctgcccaagtcttttccagcggcacgagcgcacacacaccggagaaaaaccataccagtgcaaacaatgtggcaaggccttttcactggcaggaagcttgaggcgccatgaggctacccacactggagtgaagccttacaagtgccagtgtggtaaagccttttcggacctcagttcattccagaaccatgaaactacgcatacaggagaaaagccctacgagtgtaaggaatgcggcaaagccttctcgtgctttaagtatctctctcagcacaagagaactcatactgtcgagaaaccctatgagtgtaaaacttgtcgtaaggccttctcccatttctctaatttgaaggtacatgaaaggattcactctggagagaagccctatgaatgcaaagaatgcggcaaggcattttcatggctcacatgcctcctcaggcacgagagaattcacacgggtgagaaaccatatgagtgcttgcagtgtggaaaagcattcacccggtcgcgcttcttacggggtcatgaaaagacgcacacaggtgaaaagctctatgaatgtaaagagtgtggtaaagccctctcttcactgagatcgctgcataggcacaagcgcacccattggaaagacaccttatag

SEQ ID NO: 25900 - DNA, 1410 bp, Artificial Sequence
  Description of Artificial Sequence: Synthetic coding sequence
atgaaatgggaggaccagaatattggagaccagtgccagaacgcaaagagaaatctgagatcgcacacatgtgagattaaggacgattcccaatgtggggagacatttgggcagattcccgattcaattgtgaataagaatacacctcgtgtcaacccatgcgacagcggcgagtgtggagaagtagtgctgggccattcatccctgaactgtaacattagagttgataccggccacaaatcatgcgaacatcaggaatacggcgagaagccatacacccacaaacagcgaggtaaagcgatatctcaccagcatagctttcagacacacgagcggcctcccaccggcaaaaaaccttttgactgtaaagaatgtgcaaagacttttagcagtctcggcaatctccgcaggcatatggcagctcaccatggcgatgggccttacaagtgcaaactttgcggcaaagcctttgtgtggccgagcctgttccaccttcacgagaggacccacacgggtgaaaaaccgtatgagtgtaagcaatgtagtaaggcgtttcccttctactcctcttacctgcggcatgagagaattcacaccggagagaaagcttatgagtgcaagcagtgttccaaagccttccccgattacagtacgtatctaaggcatgagcggacccacacgggtgaaaagccttacaagtgcacacagtgtggtaaggctttctcctgctattactacacccggctacacgagcgtacccacaccggagaacagccttatgcctgcaaacaatgtggaaagacattttatcaccacacaagctttcgccgacacatgattcgccatacaggcgacggcccacacaaatgcaagatttgcggtaaaggttttgactgtccatcctccgtgagaaaccatgaaaccacccacaccggcgagaaaccttatgaatgcaaacagtgcggtaaagtgctgagtcactccagcagtttccgcagccacatgattactcatacaggcgacgggcctcaaaagtgtaaaatctgcggcaaggcctttggctgcccaagcctcttccagcgtcacgaaagaacacacacaggcgagaaaccttaccagtgcaagcagtgcgggaaggcattctcgctggctgggagccttcgaagacatgaagccactcacacaggagtgaagccctacaaatgtcaatgcggcaaggcctttagcgatttatcttcctttcagaaccacgagacaactcacactggggaaaaaccgtatgagtgcaaagagtgtggaaaggcgttctcctgcttcaaatacttgtcgcaacataaaaggacacatacggtagagaagccatacgagtgcaaaacatgccgcaaagccttctcgcatttcagtaactag

SEQ ID NO: 25901 - DNA, 1287 bp, Artificial Sequence
  Description of Artificial Sequence: Synthetic coding sequence
atggccgctcaccacggggacgggccatacaagtgcaagctgtgcggaaaagcttttgtttggccatctctgttccatcttcatgagcggacccacacaggggaaaagccatacgagtgcaaacagtgcagtaaagcttttcctttctatagcagttatctccgccacgaaaggatccacactggcgagaaggcctacgagtgtaagcaatgtagtaaagcttttcccgattactccacatatttgcgccacgaacgtacccacacgggtgaaaagccttacaaatgcacccagtgtgggaaagcatttagttgttattactatacccgactccacgaacgtacccataccggtgagcaaccgtatgcatgcaagcaatgtggaaaaaccttctaccatcatacaagctttcgtagacacatgatacggcacaccggagacggaccccacaaatgcaagatctgtggaaaggggtttgactgtccttccagtgttcgcaaccacgagacgacccataccggtgagaaaccctacgaatgcaagcagtgcggaaaggttctaagtcactcatccagctttcggtcgcatatgattacgcacactggggacggaccacagaaatgtaagatctgcggaaaggctttcggatgtccctctttgttccagaggcatgaacggacccacacaggcgagaagccctaccagtgcaaacaatgtgggaaagcgttttcactggcaggctcactgcgcaggcacgaggcaactcatacaggggttaaaccctataagtgccagtgcggaaaagcattctcagacctgtcgtcattccaaaatcatgagaccacccacaccggtgaaaaaccgtacgagtgcaaggaatgtggaaaggcattttcctgtttcaagtatcttagtcagcacaagagaacacatactgtggaaaagccctatgaatgcaaaacttgtcgtaaggcgttctctcatttctcaaatctgaaagtgcacgagcgaatccattcaggggagaaaccctacgaatgcaaagaatgtgggaaggcattttcctggctgacatgcctcctccgccacgagaggatccacacaggtgaaaagccctatgaatgcctccagtgtgggaaggccttcacaagaagtagatttctgcgaggtcacgaaaaaacccatactggcgaaaagctgtacgagtgtaaggagtgtggcaaggcactatcttccctgcgtagtctccaccgtcataagaggacacattggaaagatactctttag

SEQ ID NO: 25902 - DNA, 3243 bp, Artificial Sequence
  Description of Artificial Sequence: Synthetic coding sequence
cctagccgtcaaaagaagaagaaaaagaaattaacaagcgatgtttctaggcaagaagaagccgagggagaactctctgaaggagaacactggtacggaaactcctccgaaacaccaagcgaagcaagctacggagaggttcaggaaaactataaattaagcctggaagataggattcaggaacaatctacctcacctgacacctctttgggcagcaccaccccaagctctcatacactcgagctggtcgccctggactcagaagtgctgcgcgacagcctccagtgccaggaccacctgtctccgggagtgagcagtctttgtgacgacgatccgggaagtaataagccactgagcagcaacctcagacgtttgttggaagccggttcactgaaattagatgcagctgccaccgcaaacgggagggtagaaagcccagtgaacgtgggttcgaatctcagctttagccctccgagccaccatgcacagcagcttagcgtcttagcaaggaaactggcagaaaagcaggaacagaacgaccaatatacaccctccaatcgctttatctggaatcagggaaagtggctgccgaactctaccaccacatgcagcctgtcaccagactctgctattctgaagctgaaagccgctgccaatgccgtgttgcaggataagtccctgacacgaacggaggagaccatgcggttcgaatccttttccagtcccttttcctcccagagcgctagcagcacgttggccgcactctctaagaaggtatccgaacgctccctaactcccggtcaagagcacccgcctcccgcatcctcatttctcagtctggcttctatgacctcgtccgcggctttactgaaggaggtggcggcacgggcagctggcagcctgcttgctgagaaaagttcgctgctgcctgaggatcctcttcctcctcctccctccgagaagaaacccgagaaagtgacacctccaccaccgccaccacctccaccccctccgcctcctccaccgcagagtctggagctccttctattgcccgtgcccaaagggagagtatctaaaccaagcaactctgcttctgaggaggagtcgggcaaacctttccagtgtccaatttgcggactggtgataaagcgaaagtcatactggaaacggcacatggtgatccatactggactgaaaagccaccagtgtcccctttgtccgttccggtgcgccagaaaagacaacctcaaatcgcacatgaaagtgcaccagcaccaggacagaggcgagacatttcaatgccagctgtgcccttttacgtccagcagacattttagccttaagctccatatgcggtgtcaccagcatttcctgagaacagaggctaaggtgaaggaggaaattcccgatcccgatgtgaagggctccccccatctgtcggactcagcatgcttaggccagcagcgcgagggaggtggcacagaacttgtcggcacgatgatgactagcaacacaccagaacggactagtcagggcggtgcaggcgtgtcccccctgctggttaaggaagagcccaaggaagacaatggtttgcctacctcttttacccttaatgcagccgaccgcccagccaaccatactaagctcaaggacccaagtgagtacgtcgctaatagcgcaagcgctctcttctcacaagacatatctgttaaaatggctagcgactttctgatgaagctgtcagctgccaaccagaaagaaccaatgaatttaaattttaaggtgaaggaggagccgaaagaaggggagtctctcagtactaccctgccgagatcttcctacgtgtttagtcccgagagcgaagtgagcgcacccggtgtgtccgaagacgccctgaaacctcaggaaggaaaaggctccgtcttacggagagacgtgagtgtgaaagccgcttccgagctgctgatgaagctgagcgccgaatcttataaagagacacagatggttaagataaaggaagagccaatggaggtggacattcaggatagtcacgtctccatctcccctagccgcaatgtgggttactctaccctgatcggcagagagaaaaccgaacctctgcagaaaatgcctgaaggaagggtgccgccagaacggaatctgttcagccaggatatcagcgtgaagatggcctccgagctcctatttcagctgagcgagaaagtatccaaagaacataatcacaccaaagaaaacacaatcagaacaacaacttcaccatttttctctgaggataccttccggcagtctccgttcacatccaattctaaggaattattgccatccgacagcgtgcttcatggcagaatatctgctccagaaactgagaaaatcgttctcgaggccggtaacggtctgccatcatggaagttcaacgaccagctgttcccctgcgacgtctgcggcaaggtttttggaagacagcagaccctgtctcggcatcttagcctccacacagaggaacgaaagtacaaatgccacctttgcccttacgctgccaagtgccgagcgaacttaaatcagcatctgactgtgcattctgtcaaactcgtgtccactgataccgaggacattgtgtcagccgtaaccagtgagggctctgatggcaagaaacacccctactactacagttgccatgtgtgcgggttcgagacagagctcaatgtgcaatttgtgtcccacatgtcgttacacgtcgataaggagcagtggatgtttagcatctgctgtactgcttgtgacttcgtcactatggaggaagctgaaattaagacccatataggcaccaagcacaccggagaagatcggaaaacgccttcagaaagcaattctcccagctcgtcctcactcagcgctcttagcgattcggcgaatagcaaagacgattccgatgggtcgcagaagaataaggggggaaacaacctgctggtcattagcgttatgcccggaagccaaccatctttaaactcggaggagaaaccagaaaagggtttcgaatgcgttttctgcaattttgtgtgtaaaacaaaaaatatgttcgagaggcacttgcaaatccatttgataacacgtatgttcgaatgcgatgtctgtcacaaatttatgaagactcctgaacagctcctggaacacaaaaagtgccacaccgtcccaactggaggtctgaactccggtcagtggtag

SEQ ID NO: 25903 - DNA, 2196 bp, Artificial Sequence
  Description of Artificial Sequence: Synthetic coding sequence
atgccccgaaggaagcaagaacagccgaagcgcttgcccagtccttccgaagaggagtcgggaaaaccattccaatgtcctatttgtgggctggtcataaaacgaaaatcctattggaaaagacatatggtaattcacacaggcctgaagagccaccagtgcccgttgtgccctttccgctgtgccaggaaagacaatctgaagtcccacatgaaagtgcatcaacaccaggatcggggagaaacgtttcagtgccagctatgtcctttcacttcaagccgacacttcagcctaaagctccatatgagatgtcaccaacactttcttagaacagaggccaaggtgaaggaggagatccccgatccggatgttaaggggtcaccacacctgtcggacagtgcttgtttaggccagcagcgggaaggcggagggactgaactggtaggaaccatgatgacttcgaatacacccgaacggacatcccaggggggagcaggcgttagtcctctgcttgtgaaggaggagcctaaagaagataacgggcttcccacaagttttaccctgaatgccgctgaccgccctgctaaccacactaaattgaaggaccccagcgagtatgtcgctaacagcgcctcagcactgttttcccaagatatcagcgtgaagatggcctctgacttcctgatgaagcttagcgcagctaatcagaaagaacctatgaatttaaattttaaagttaaggaggagccaaaagagggggagtcattaagcacaacattacctcgaagctcctacgtgttctctcccgaatccgaggtctccgcccctggagtatccgaagacgccttaaagcctcaggagggaaagggatctgtactgaggcgagatgtgtcggtcaaggccgcttccgaactgctgatgaagctgagcgcagaaagttacaaggagacgcaaatggtgaagatcaaggaagaacccatggaagtggatattcaggactcccacgtttcaattagcccctccaggaatgttggttactcaacactgatcggcagggagaagacagagcctctccagaaaatgcctgagggcagagtgccgccagaacggaatctgttttcccaagacatctcggtgaagatggcatcagaattactttttcaactcagtgaaaaggtaagtaaggaacacaaccataccaaagaaaacacaatccgcactaccacgtcaccgttctttagtgaggacacctttcgacaatccccatttaccagcaatagcaaggaactgctgcctagtgattcagtgcttcatgggaggatcagtgctccggagaccgaaaagattgtcctggaggcagggaacggactgccttcgtggaagttcaacgaccaactcttcccctgcgatgtgtgcggtaaggtattcggaaggcagcagaccctgtcccgccatttatcactgcacaccgaggagagaaaatacaagtgtcacttgtgcccgtatgctgctaagtgtcgggcaaacctcaaccaacatctcactgtccattctgtgaagcttgttagcactgatacagaggatatagtgagcgctgtgacatctgaggggtccgacgggaaaaaacacccctattattacagctgccatgtgtgtggctttgagactgagctgaatgtgcagttcgtctcccacatgtcactccacgtcgataaggagcaatggatgttctctatctgttgtacggcatgtgacttcgtgactatggaggaggctgaaatcaagacacatattggtactaaacacaccggggaggataggaaaacaccaagcgagtctaactcgccgtccagctcttccctgtcagcattgagcgattcagccaactccaaggatgattcggatggcagccaaaagaacaaggggggaaacaatctgctcgtcatttcagttatgcccggaagccagcctagtctcaatagcgaagagaagcctgaaaaaggcttcgagtgtgtcttttgcaatttcgtgtgtaaaacgaaaaacatgtttgagcgacacctccagatccacctgattacgaggatgtttgagtgtgatgtatgtcacaagtttatgaagaccccagagcagttgctggaacataagaaatgtcacaccgtccccaccgggggattgaagcgaggcgcttggtag

SEQ ID NO: 25904 - DNA, 3246 bp, Artificial Sequence
  Description of Artificial Sequence: Synthetic coding sequence
atgcccaggcggaaacaagagcaacctaaaaggttacccagccatgtcagtcggcaggaggaggctgaaggcgaactgtcggagggagaacactggtatggaaacagttcagaaaccccctccgaagcctcttatggcgaagttcaggagaactataaattaagcctggaagaccgaatccaagaacaaagcacaagtccggacacatctctgggcagtaccacgccctcttctcatacccttgagctggtggcccttgactcagaggtgttaagagattcccttcagtgtcaggaccacctaagccctggagtgagcagtctatgcgacgacgatcctggatcaaacaagccactatcaagcaacttaagaaggttgctggaagccggatcactgaaactggacgccgcagcaaccgcaaatgggagggttgagagtcctgtcaacgttggctccaatctctccttcagtcctccctcacatcatgcccaacagttgagtgtcctggccaggaagcttgcggagaagcaggaacaaaatgaccaatatacacctagcaatcgatttatttggaatcaaggcaagtggttacctaacagcacaaccacctgctccctgtctcctgactctgctattctgaaactaaaggcagctgccaacgccgtgctccaggacaaatcactcaccagaacagaagaaaccatgaggttcgagtcgttttcctctccattttctagccagtctgctagctccactctcgcagccctcagtaaaaaggtttctgagagatctttgacccctggccaagagcatccaccccctgccagcagctttctttcgctcgcaagcatgactagctccgccgctttgttaaaggaagtggcagccagggcagccggtagcctgctggcagagaaatcatcgctccttcccgaagatccactccctcctccaccctccgagaaaaaacctgaaaaggtgacacctcctccaccacctcctcctccaccgcctccacctccaccaccgcagtctttggagcttctgcttttacctgtgcccaaaggccgtgtcagcaagccaagcaattcagccagcgaggaggaaagtggtaagccctttcaatgcccaatctgcggccttgttattaaaaggaagagctattggaaacgccacatggtaatccatactggcttaaaaagtcatcagtgtccactgtgcccattcaggtgcgcgaggaaagacaacctgaagtcccacatgaaagtgcatcaacatcaggacagaggcgaaacgttccagtgtcagctctgccccttcacctcatctaggcattttagcctgaaactgcatatgaggtgccaccagcacttcttaaggacagaggctaaagtcaaggaggagatccccgaccctgacgtgaaggggagtccacatttatcagactccgcttgtctagggcagcaacgagagggcggaggcaccgaactggtcggcacgatgatgacctccaacacacccgaaagaacttcacaggggggtgccggagtgagcccactcttggttaaggaagaacccaaggaggacaatgggctacctacaagcttcacactcaatgctgcggatcgcccagcaaatcacaccaaattgaaagatccatcagagtacgtggcgaattccgcttctgctctcttcagccaggacatttcagttaagatggcctccgacttcctgatgaagctgtctgcagctaatcaaaaagaacccatgaacttaaattttaaagtgaaagaagagcctaaagagggagaatccctatctactaccctgccacgctcatcctacgttttcagtcctgagtcagaagtgagcgcacctggggtttctgaggacgcacttaagccccaggaggggaagggctctgtgctcagacgcgacgtgtctgttaaggccgcttccgagctgctcatgaaactttccgccgaaagttacaaggaaacccagatggtgaaaatcaaggaggagcccatggaggtggacattcaggacagtcatgtatctattagcccatctcgtaatgtgggttactccacccttatcggccgagaaaaaactgaaccccttcagaaaatgccagaggggagggtgccacccgaaagaaatcttttctcacaggatatatcagtgaaaatggctagcgaattgctgttccagctgtcggaaaaagtgtccaaggagcataatcatactaaggaaaatactattcggaccaccacttctccgtttttttctgaagataccttccggcagtcccccttcacttccaacagcaaagaactccttccatctgactccgtgctgcacggcagaatatcagcacccgagacggagaaaattgttcttgaagcgggtaatgggttacctagctggaaattcaacgatcagctgtttccatgtgatgtgtgtgggaaggtgtttggcaggcagcagacgttatcaaggcacctgtcattgcatacagaagagcggaaatataaatgccacttgtgtccttacgctgccaaatgtcgcgctaatctaaatcaacacttaacagtccacagcgtgaaacttgtgagcaccgacactgaggatattgtgtccgcagtgacttccgaggggtccgatggaaaaaagcacccttattactacagctgccatgtgtgtgggtttgaaacagagttaaatgtccagtttgtgagccatatgtcactacacgttgataaagaacagtggatgttctctatctgttgtactgcttgcgactttgtgacaatggaggaggctgaaatcaagacacatatcggaacgaagcacacaggggaagatagaaagacaccttccgagtcaaactccccttcatcaagctccctgtccgccttgtctgactccgccaactcgaaggatgatagcgacggcagccagaagaacaagggaggcaacaatctcttggtgattagtgttatgcccggtagtcagccaagtctaaattctgaggaaaagcccgaaaaaggattcgaatgtgtgttctgcaacttcgtgtgcaagaccaaaaatatgttcgaacggcacttacagatacatctgataaccaggatgttcgagtgtgacgtgtgccacaaatttatgaaaactccagaacagctactggagcataaaaagtgtcacacggtgccaactggcggactcaattctggccagtggtag

SEQ ID NO: 25905 - DNA, 2196 bp, Artificial Sequence
  Description of Artificial Sequence: Synthetic coding sequence
atgcctaggaggaagcaggaacagccaaaaagacttccaagcccttcagaagaagagtccgggaagcccttccagtgtcccatctgtgggctcgttataaaacgcaaatcctactggaaacgacatatggttatacacacaggactcaagtctcaccagtgtcccctttgtccgttcagatgcgccagaaaggataacttaaagtctcatatgaaggtccatcagcaccaggacaggggggagacgttccagtgtcagctatgcccattcacgtcttctagacattttagtctgaagctgcacatgagatgccaccagcactttcttaggacagaggcaaaagtgaaggaggagatcccagaccctgacgtcaagggttcaccccacttgagcgatagtgcctgtttagggcaacaaagagaaggcggtgggacagagctggttgggaccatgatgacaagtaacacccctgaacggaccagtcaaggtggcgcaggcgtgagccccctattagtcaaggaggaaccaaaggaggacaacggcctccctacaagcttcactcttaacgccgctgaccggccagctaaccacacaaaactcaaggacccatctgaatacgtcgccaacagtgcttctgcccttttctcccaggacatctccgtcaagatggcctccgactttctgatgaagctgagtgctgccaatcagaaggagccaatgaacctgaattttaaagtgaaagaagagccaaaggagggggagtcactctcaacaacgctgcctcggtctagttatgtcttctcacccgagagtgaggtgagcgccccaggtgtgtctgaagatgcactgaaaccacaggaggggaaggggtcagtcctgagaagagatgtgagcgtgaaggccgctagtgaactgctcatgaaactctccgctgaatcttataaggaaacgcagatggtgaaaattaaggaggaacctatggaagtggatatacaggatagtcatgtctccatctccccctctcgcaatgtcgggtacagcacacttatcggaagagaaaagacagagccactgcaaaagatgcccgagggccgagtacctcctgagcgaaacctgttttcgcaggacatttctgtgaaaatggctagcgaactgctgtttcagcttagtgagaaagtctctaaggaacacaaccacacgaaagagaatacaattaggaccaccacatctccgttcttctcggaggacacatttcggcaatccccattcacctctaacagtaaggaacttctgcctagcgactcagttcttcacggccgaatttccgcccctgaaacagaaaagattgtcctggaagctgggaacgggttacctagctggaaatttaatgatcagcttttcccctgcgacgtctgcgggaaggtgttcggtagacagcagacgctcagccggcacctgtctctgcacaccgaggagagaaagtataaatgccatctgtgtccttatgccgctaaatgccgtgccaatctgaatcagcacctaacagtgcattccgtaaagctcgtctccacagatacagaggatatcgtgagtgcagtgacatctgaagggtccgatggcaagaagcacccctactattattcttgtcatgtgtgcgggtttgaaacagaactcaatgtgcagtttgtttcccacatgtcgctacacgtggacaaagagcagtggatgttcagcatttgttgcacagcctgtgacttcgtgactatggaagaggcagaaattaagactcacataggcacaaagcacactggcgaggacagaaaaactccctccgaatctaacagtccgagcagtagctcactctcagctttatccgattccgccaatagcaaggatgattcagatggttctcagaagaacaaaggcggtaataatctgctggtgattagtgtgatgcccggatctcagccctctctcaacagcgaagaaaagcccgagaagggcttcgaatgtgtgttctgtaacttcgtttgcaagaccaaaaacatgttcgaacgacacttacagatacatttgatcacacgtatgttcgagtgcgacgtatgtcacaaatttatgaaaaccccagaacaactcctcgaacacaaaaaatgccacaccgtcccaactggtggtttaaattctggccagtggtag

SEQ ID NO: 25906 - DNA, 3234 bp, Artificial Sequence
  Description of Artificial Sequence: Synthetic coding sequence
atgccgagaagaaaacaggagcaacccaaaagattgccatcacacgtctcccggcaggaagaggccgagggcgagctctctgaaggagagcattggtacggaaatagcagcgaaacaccgtccgaagcctcgtacggtgaagtgcaggaaaattataagctgagcctcgaagatcgaatccaggaacagagtacctcgcctgatacaagcttaggcagtaccacgccaagcagccacacacttgagttggtcgctctcgattcagaggtgctccgcgacagcttgcagtgtcaagaccacttgagccccggagtaagttccctgtgcgacgacgaccccggatcaaataaacctttgtcttctaacctgagacgcctgttggaggccggatctctgaagcttgacgcagccgcaacagcaaacggacgcgtggagtcccctgtaaatgtgggcagcaatctgtctttctccccccctagccaccatgcacagcagcttagtgttctagccagaaagctggccgagaagcaggaacaaaacgatcagtacacccctagtaatcggtttatttggaatcaagggaaatggctacccaattcaacaacaacgtgcagcctttcgcccgatagcgctatactgaaacttaaggcggctgcaaatgccgtgttgcaggacaaatctcttaccaggactgaggaaacaatgcggtttgagtccttttcctcgccattctcctcgcaaagcgcatcttcaacactagctgcactgtccaaaaaagtgtccgaacggagtctgacacccggacaggaacatccaccgcctgccagcagctttctgagtctcgctagtatgacatcatctgctgcattgctgaaagaggtggccgctcgcgcagctggctcgttgcttgcagagaagtcttccctgctgcctgaggacccactgcctcctccaccatctgagaaaaaacccgaaaaggttacaccccctccccctccacccccaccccctccacccccaccacccccacagagtttagagctactgctgctgccagtccctaaaggacgcgtgtccaaacctagcaactctgcgagcgaggaggaaagcggtaagccatttcagtgtccaatctgtggacttgtgattaagcggaaaagttactggaaaaggcacatggtcattcataccggattgaaaagtcaccaatgtcccctgtgccccttccggtgtgccaggaaggacaacctgaagtctcatatgaaggtgcaccaacaccaggatcggggagagactttccagtgtcagctttgcccttttacaagctcaaggcactttagtctgaaactgcatatgagatgccaccagcattttcttagaactgaagcgaaggtgaaggaggagattcccgaccctgacgtgaagggttccccccatctgagcgattcagcctgcttggggcagcagagagagggagggggaaccgaactagtgggtacaatgatgacttctaatacccccgagcggacctcacagggcggagccggagtctctccactgttggttaaggaggagcctaaagaggacaatgggcttccaactagtttcaccctgaacgcagctgaccgcccagccaaccacacaaagctaaaggatccttcagagtatgtggcaaactccgcatctgctctgttttcccaggacattagtgtaaagatggcttctgattttctcatgaaactctcagccgcaaaccagaaagagcccatgaacctcaactttaaagttaaggaggagcctaaggagggcgagtcgctctctacaacacttccaaggagttcttatgtgttctcccctgaatctgaagtgtccgcccctggtgtctcagaggatgccttgaaacctcaggagggcaagggtagtgtccttagacgtgatgtcagcgtaaaagcagcaagcgagctgctaatgaagcttagcgctgaaagctacaaggaaacacaaatggttaagatcaaggaagaaccaatggaggtagacattcaagatagccatgtgtctatctctccgagtcggaacgtaggatactcgaccctgattggaagggagaagacagagccattgcaaaagatgcccgaggggagagtcccgccagagcgcaatcttttttctcaggatatctccgtcaagatggcttctgaactgctttttcagctgtccgagaaggtttccaaagagcacaaccacacaaaagagaacaccatcaggacaacaacaagtccttttttctcggaagataccttcaggcagagcccgtttacgtctaactcaaaggaactcctcccttctgactcagtgctacatggcagaatctctgccccagaaacagagaagatcgtgttggaggccggaaacgggctcccttcatggaaatttaatgaccagctgtttccctgtgacgtttgcggcaaggtatttggacgccagcagacactcagccgccacctctcactgcacactgaggagagaaaatataaatgccacctgtgcccgtatgccgcaaagtgtcgggcaaatctcaaccagcatctcacagtgcactccgttaagctagtctcaacggatacagaggacatcgttagtgccgtgacaagcgagggtagtgatggtaagaaacatccgtattattattcttgccacgtttgtggatttgagaccgagctaaatgtccaatttgtgtctcacatgtccctgcatgtcgataaagaacagtggatgttctccatttgttgtacggcttgcgattttgtaaccatggaggaggctgaaatcaaaactcacatcggaaccaagcatacgggagaggaccggaaaacaccttccgagtccaactctccttcaagcagctccctgtctgctctgtccgactctgccaattccaaggatgactcagatggcagtcagaagaacaagggcggtaacaacctgctggtcatctcagtgatgcccggttcccaaccttccctcaacagtgaagaaaaacctgagaaaggattcgagtgcgtattttgtaacttcgtctgcaaaaccaagaacatgtttgagaggcacctgcagatacatctgataacaagaatgttcgaatgcgatgtgtgccacaaattcatgaaaaccccggagcagctcctggagcataaaaagtgtcacactgtccctaccgggggtctcaagtag

SEQ ID NO: 25907 - DNA, 1299 bp, Artificial Sequence
  Description of Artificial Sequence: Synthetic coding sequence
atgccccattctccactcatctcgattccacacgtgtggtgtcatcctgaagaggaagaaaggatgcacgatgagttgctgcaggctgtgtccaagggacccgtcatgtttcgggatgtgagtatcgatttctcccaggaggaatgggagtgtttggacgctgaccagatgaatttatacaaggaggtcatgttggagaactttagcaacttggtgagtgtggggctgagtaatagcaagcctgccgtgatctccctgttggaacagggtaaagagccgtggatggtggatcgcgagctcaccagggggctgtgctccgacctcgaatccatgtgtgaaaccaagatcctgagcttgaagaagaggcacttcagccaggtcatcattaccagggaggacatgtccactttcatacaaccaacctttttaattccccctcagaaaaccatgagtgaggagaagccatgggagtgtaaaatttgcggcaaaacctttaatcaaaatagccaattcattcaacatcagcgaattcatttcggagaaaagcactacgagtcaaaggaatatggcaagagcttttctagaggctccctggttaccaggcaccagcggatacatacagggaaaaagccctacgagtgcaaggagtgcggcaaggcgttctcatgttcttcgtatttttctcagcaccagcggattcacacaggtgagaagccttacgagtgtaaagagtgcggaaaagctttcaaatactgctcaaacctgaatgaccatcagcgtattcatactggcgaaaaaccctatgagtgtaaagtgtgtgggaaagcctttactaagtcttcccagctgttcctgcatctgcggatccacaccggagaaaagccatatgagtgcaaggagtgcggcaaagcttttacacagcactccagactcattcaacaccagcggatgcacacaggcgagaagccctatgaatgcaagcagtgcgggaaagcattcaatagcgcttccactctgactaaccaccatcggatacacgctggagagaaattatacgagtgcgaagagtgcagaaaagccttcatacaatcgtctgaactgatccagcatcagagaatccataccgacgagaagccctatgaatgcaatgaatgcggtaaggcattcaacaagggatccaacctcacaaggcaccagcgtatacacactggggaaaagccgtacgattgcaaagagtgcgggaaggctttcgggtccaggtcggacctcatccggcacgagggtattcatacgggatag

SEQ ID NO: 25908 - DNA, 1299 bp, Artificial Sequence
  Description of Artificial Sequence: Synthetic coding sequence
atgccacactcacccctcatcagcatcccacacgtgtggtgtcaccccgaggaggaagagcgaatgcacgacgaacttctccaagcggtcagtaaaggcccagtcatgtttagagacgtgtctatagacttctcacaagaggagtgggagtgcctggacgcggatcaaatgaatctgtataaggaggtgatgctggaaaatttcagcaacctggtgtccgtcggactctccaacagcaagccagctgtcatctcccttcttgagcagggaaaggaaccatggatggtggatcgcgagctaactaggggcttatgttctgacctcgaaagtatgtgtgagactaaaatcctatctcttaagaagcgacatttttcccaggtgatcatcactcgggaagacatgagtactttcatccagcccaccttcttgattcctcctcaaaagactatgtcagaggagaaaccatgggaatgtaaaatctgtgggaaaactttcaaccaaaactctcaattcatccagcaccagagaatccatttcggggagaaacactatgagtcaaaagagtatggtaaatctttcagccgcggtagtcttgtgacccggcatcagcggatccatacgggcaagaagccatatgaatgcaaggagtgcgggaaagcctttagctgctcaagctactttagccaacaccagcggatacacacaggggagaagccttatgagtgtaaggaatgcggtaaggctttcaagtattgttctaatctgaacgaccaccagcgaattcacaccggagaaaaaccttacgaatgtaaggtatgcgggaaagcatttacaaaatcatcccagttatttcttcacctccggattcacaccggtgaaaaaccgtacgagtgcaaggaatgtgggaaagcctttacccagcactctcgcctgatccaacaccagcggatgcatacaggagagaagccctacgaatgtaagcagtgcggcaaggcttttaacagcgctagtacactgaccaatcatcacaggatccacgcaggcgagaagctgtacgaatgtgaggaatgccgtaaggctttcatacagtccagcgagctgatccaacatcagcgtatccacactgacgaaaagccgtatgaatgcaacgaatgtggaaaggccttcaataagggcagcaatttgacgagacatcaaaggattcatacgggagagaagccttatgactgtaaagagtgcggcaaagctttcggatcgcgcagtgaccttatcagacatgagggaatccacacaggctag

SEQ ID NO: 25909 - DNA, 2811 bp, Artificial Sequence
  Description of Artificial Sequence: Synthetic coding sequence
atggccctgactcaggggccactgacattcagggacgtagctatagaattttcacaggaagaatggaagtctctcgatcctgtacaaaaagccctgtactgggatgtgatgctagaaaactacagaaaccttgtctttctagggatccttcctaaatgtatgactaaggagctaccacccattggaaactcaaacactggggaaaagtgccagaccgtgacactggagcgccatgagtgttacgacgtggaaaatttctatctgcgcgagatacagaagaaccttcaggacctcgaatttcagtggaaagacggtgaaataaactacaaagaagttccgatgacctataagaataatttaaatggaaagcgtggacaacactcgcaggaagatgtggagaacaagtgtatcgaaaatcagttgaccctgtcctttcagtctcggcttaccgaactgcagaaattccagacagagggcaagatttatgagtgcaaccagagtgaaaagaccgtaaacaatagctcactcgtctcacctctccagagaatcctgccatctgtccagaccaacattagcaagaagtatgaaaatgaattcttgcaactgagcctgcctacccagttggagaagacacacattagagagaaaccctacatgtgcaaggggtgtgggaaagcatttagggtttcttcatccctcattaatcaccagatggtgcatactaccgagaagccttacaagtgtaacgaatgcggtaaggccttccacaggggatccctgctaaccatacaccagatcgtccatactagaggaaaaccataccagtgtggtgtgtgtggtaaaatctttcgccagaactccgatctcgtgaaccataggcggagccacacaggcgagaaaccttacaagtgcaacgaatgcggaaagtccttctcccagtcctacaatctcgccatccaccaaagaattcacactggcgagaaaccttataagtgcaacgagtgtggaaagaccttcaagcaggggtcttgtctgactacacaccagatcatccacacgggtgagaagccttaccagtgcgacatctgcgggaaagtctttaggcagaacagtaatctagtaaaccatcagcggatccacacaggtgaaaagccttataaatgcaatatatgtggaaaaagcttctcccagagctcaaatcttgccacacatcagaccgtgcactcgggtaacaagccctacaagtgtgatgagtgtggaaagacattcaagcgcagctctagtctgacaacccatcagatcatccacacgggagaaaaaccttatacttgcgacgtctgcgacaaagtgtttagccagaggtcccagttagcccgacaccagcggagccacacaggtgaaaaaccctataaatgcaacgaatgcggaaaggtgttcagccagacatcccatttggttgggcacagacgaatccatacaggtgagaagccctataaatgcgataagtgtggaaaggcttttaagcagggtagtctgttaaccaggcataagattatacacacaagagaaaagcgatatcagtgcggcgaatgcggaaaggttttttcagaaaactcatgtttggtgcggcatctccgaatccatacaggcgagcaaccctacaaatgtaacgtgtgtgggaaggtctttaattactctgggaatctttccatccataaacggattcacacaggtgagaagccttttcagtgtaacgagtgtgggaccgtgttccgcaactactcatgcttagcacgacacctccgcatccacaccggccagaaaccatacaaatgcaacgtgtgcggcaaagtgtttaatgattctggtaatctcagtaaccataagcgtatacacacaggagagaagcctttccagtgtaatgagtgtggtaaggtatttagctactatagctgcctggctagacatcggaagatacatacaggcgaaaagccctacaaatgtaatgattgcggaaaagcatatacgcagaggagcagccttacaaaacatcttatcatccataccggtgagaaaccttataactgtaacgaattcggtggagcattcattcagagctccaagcttgcacggtaccaccggaaccccacaggagaaaagcctcataagtgctcccactgcggaagaacttttagccatatcacaggtctcacctaccaccagagacggcacaccggcgagatgccatacaagtgcatcgaatgcggccaagtctttaactccacaagcaacctggctagacatcgaagaatacacactggtgagaagccttataagtgcaatgaatgcggcaaggtgttccgccatcagtccacattggctaggcacaggtctatccacactggggaaaagccgtacgtatgtaacgagtgcgggaaggccttccgcgtgaggtcaatactcgttaaccatcagaagatgcatactggagacaagccctacaagtgtaacgaatgcggaaaagctttcatcgaacggtctaaattggtatatcatcagaggaaccatacgggtgagaagccatacaagtgcatagagtgtggcaaagctttcggtcgattcagttgtctgaacaagcaccagatgatccatagcggcgaaaaaccctataagtgcaatgagtgtggaaaatcatttattagccgtagcgggctgacaaagcaccagacaaaacataccgccgaatccctgaagacaaagttcaacgtggagaaacccctggacgttctgctcacctccgggttcaagtag

SEQ ID NO: 25910 - DNA, 534 bp, Artificial Sequence
  Description of Artificial Sequence: Synthetic coding sequence
tctttgcccacacagctggagaagacacatatcagagagaagccttatatgtgcaaaggctgtggaaaggcgtttagagtgagctcctctctgatcaatcatcagatggtccacactaccgagaaaccttacaagtgcaatgagtgcggaaaagcttttcaccgaggcagcctgttaaccattcaccagattgtccatacacgcggtaagccttaccagtgtggggtgtgtggtaagatcttccggcagaacagcgacctggttaatcatcgacgcagtcatacaggcgagaagccctataaatgcaatgagtgcgggaaaagtttcagtcagtcttataatctagcgatccatcaaagaatccatacaggtgagcagccctacaaatgtaacgtatgcgggaaggtcttcaattatagtggaaatctgagcatacacaagcgaattcacaccggagaaaagcccttccagtgcaacgagtgtggcactgtattcagaaactatagctgcttggctcgacatctgagaatatag

SEQ ID NO: 25911 - DNA, 1596 bp, Artificial Sequence
  Description of Artificial Sequence: Synthetic coding sequence
atggaggccccagcccagaaagccggtcaagggggactgcctaaagcggatgcccagggagcatccggggctcgggaaaaaaggcctgaggagcccagacccctcgaagaggaccgcgctggttcacggcctacacagaagggtgacctccggggagccgctgggggacgcaccacccctccagggggagggtcacgagggtgtagtctaggcgttagcccaggcccagggaccaggcatagcgcaggaactagacccctggtgcgagaaccctgcggccctacttcatcccagaacccagaactggtcatccccgaagggctccaggctagggaaggtccttgcaggtctcctgcacggggtggggactgttctagaaatagttgcctcgcttggcacagaggtgcccctgctggagaaacgcccccagtttgtgacccttgccctgaaagaatccagaatcaccctagaactcagctgtgcgaagttcacaccgactgctggccctgtcagccaggtaccggggctccaacttgccctcgcacccccaaacctaccagcagggggcgtaatcctcttgtcgagcagccacgcgcttgcgcatgtggagaggcctttgcttggcgggcactaagaatcccccaggaacgcctacaggctaccgaggaacccagaccatgcgcgcgatgcggtaagcgatttcgacctaaccagcagcagcaggccggtaagtcccctccagtgtgtccagaatgtggacagacctcccgtcctcgaccaatcgtcccagatcccccagcacagcgcctgtacgcctgcgatgaatgtggaaaggcattcacccgcacttcttcccttctgcagcaccaaagaattcacacaggtgaaaggccctacgagtgtgcagagtgcgggaaggcatttgttcgctgctctggcctctatcgccaccagaagacccacagcgcagagcgccaccgcagggggcctgtactggcaagacgcgcattcaggcttggttgccccccatgcggagactacagtgagaggagtcctcgcagggggagtggcgcaggtgagaagccctacgaatgtgccgactgcgccaaggccttcggcctgtttagccatttagtggaacataggagagttcacactggcgagaagccatacgcatgtcccgagtgcgggaaagccttcaaccagaggagtaacctgtcccgtcaccagcggacgcatagttccgcaaagccttatgcgtgcccactgtgcgagaaagcattcaagggcaggagcggacttgttcagcaccagagagcccacactggagagcggccttacggatgtagtgagtgcgggaaaacctttaggggttgctcagaattgcggcagcatgagcgtctgcatagtggtgagaaaccttatatttgtagagactgtggaaaggccttcgtgagaaactgctccttggtcaggcacctgaggacccatacaggcgaacgcccttacgcatgcggtgattgtggcagagcctttagtcagaggagtaatctgaatgagcatcgcaaacgacacggcggaagggcagcaccgtag

SEQ ID NO: 25912 - DNA, 1596 bp, Artificial Sequence
  Description of Artificial Sequence: Synthetic coding sequence
atggaagctcctgcgcaaaaggccggacaaggaggcctgcccaaggctgatgctcaaggggctagtggtgcaagagagaagaggcccgaggaacctaggccattagaggaggatagggccggatcgcggccaacccagaagggggatctaagaggcgctgcaggcggacgtacgactcccccaggaggaggcagtagaggatgtagccttggagtttccccgggtcccggtacccgacactccgcgggaacaaggccactcgttcgcgaaccatgtggacccacctcgtctcagaacccggagctcgtgataccagaagggttgcaagctcgcgaggggccttgtaggtcccctgccagggggggagactgctcccgcaactcctgcctggcctggcacaggggggctcccgcaggggagacgccccctgtgtgtgatccgtgtcctgagaggatccagaaccatcccaggactcagttgtgtgaggttcacaccgactgctggccctgtcaaccagggactggggctccgacatgtccacggacgcccaagcccaccagtcgcggtaggaaccctctcgttgaacagccccgagcttgtgcgtgcggggaagcgtttgcctggagggccctccggataccacaggagagactccaggccaccgaagagccaagaccatgcgcacggtgtggcaaaaggttccggccaaaccagcagcagcaggctggaaaatcccctccagtgtgccctgagtgcggacaaaccagccgccctcggcctattgttccagacccccctgcccaacgactctacgcctgcgatgagtgtggaaaggctttcaccagaactagttccctgcttcaacaccagcgcattcatactggcgaaagaccttacgagtgcgcagagtgtggcaaggcatttgtgcggtgtagcggcctttacaggcatcaaaaaactcacagtgccgaacggcaccgccgaggacccgtattagctagacgcgcttttagacttggatgtcccccatgcggcgattatagcgagagatcccctcggcgtggttctggcgctggtgagaaaccttacgaatgtgctgattgtgccaaagcgttcggcctgttttcgcatctcgttgaacacaggagagtgcataccggcgaaaaaccctacgcatgtcccgaatgcgggaaggccttcaatcaaaggtccaacctaagccgccaccaaagaacgcactcttcagcaaaaccatacgcctgccccttatgtgagaaagcctttaagggcaggagcggtttggtgcagcatcagcgtgctcataccggggagcggccatatggctgctcagagtgtggcaaaacgtttcgaggatgttccgaattacggcagcacgagagactgcactccggagaaaaaccctacatttgccgcgactgcggaaaggcattcgttcgcaattgttctctcgtgcgccatttacgcacacacaccggtgagagaccgtacgcttgcggggattgtggacgcgcattctctcaaaggtcaaatttaaatgagcataggaagcggcacggcggtcgggctgcgccttag

SEQ ID NO: 25913 - DNA, 2217 bp, Artificial Sequence
  Description of Artificial Sequence: Synthetic coding sequence
atgacaatgctgcaagaatccttcagcttcgacgacctgtcggtggacttcacacaaaaagaatggcagctgctcgatcctagtcagaagaatctatacaaagacgtgatgctcgaaaattacagctcactggtctccttaggctacgaggttatgaagcctgatgttatcttcaaactggagcagggcgaggaaccttgggtcggcgacggcgaaataccatcttcggatagtcctgaagtgtggaaagtggatggaaatatgatgtggcaccaggacaaccaggacaagctgaagatcatcaagcgtggacatgaatgtgacgcatttggcaagaatttcaacttgaacatgaattttgtccccctcagaaaatcaaatagcgagggtgatctggatgggcttatccttaagcaccatctcgatctgttaattcctaagggcgactacggtaaagcagagtccgatgactttaatgtctttgataatttcttcctgcattctaagccagaagacacagacacttggctcaagtactatgattgcgacaagtataaggaatcatacaaaaaaagccagattattatctaccacagaaacaggctgggggaaaagctgtatgaatgctccgaatgtcgaaagcgcttcagcaagaaacccagtctgatcaagcaccagtcacggcacattcgcgacatagcattcggatgcggaaactgtggaaagaccttccctcagaagtcccagttcatcactcaccacaggacccataccggggagaaaccctataattgctctcaatgtggaaaagccttttcccagaagtctcagctgaccagccatcagcggactcacaccggagaaaagccttacgagtgcggcgaatgcggaaaggctttctcaaggaagtctcacttgatctcacactggcgaactcacacgggagaaaagccttacggctgcaatgaatgcggacgcgcttttagtgagaagagtaacttaataaatcaccaacgaatccacacaggggagaaacctttcgagtgtcgcgaatgtggcaaagccttcagccggaagagccaacttgtaactcatcatcgaacacatacgggcactaagcccttcggctgcagcgattgtcgcaaagctttttttgaaaagagtgagctgatcagacaccagactattcacacaggggagaaaccctacgagtgttccgagtgccggaaagcattcagagaacggagctcacttattaatcatcaacgtacccatactggggagaaaccgcacggttgcattcagtgcggaaaagccttcagccagaaatctcaccttattagccaccagatgacccacacgggcgagaaaccttttatttgtagtaagtgcggaaaagccttctccaggaagagtcagcttgtaagacaccagagaactcacaccggagagaaaccttatgaatgtagcgagtgtggtaaggcgttctctgagaaactgtctctgaccaatcatcagcggatacatacaggtgagaagccttatgtgtgctctgaatgtggcaaagcgttctgccagaagtcccacttgatatcccatcaaagaactcacacgggtgagaaaccatacgaatgctctgaatgtggcaaagccttcggagagaaaagctccctggccacccaccaacgaacccatacaggagagaagccatacgaatgtcgcgactgcgaaaaagcgttctcccagaaaagtcaactgaatacccaccagcgcattcatacgggagagaagccatatgagtgttctctttgccggaaggccttctttgagaagagtgagttaattcgacatttgaggacccacactggggagaagccttatgaatgcaacgaatgtcggaaggcattcagggagaaatcatcacttatcaatcaccaaagaatccacacaggcgagaaacccttcgaatgcagtgaatgtgggaaggcattttctcgaaagtcacatctgatcccccaccaacgcacccacactggagagaaaccctatggctgttcagagtgcaggaaagccttttcccaaaagtctcagctggtaaatcatcagagaatacacacaggagaaaaaccataccgctgcatcgaatgcggcaaggcttttagccagaagagtcagctgattaaccaccaacgtacacataccgtaaaaaaatcatag

SEQ ID NO: 25914 - DNA, 2217 bp, Artificial Sequence
  Description of Artificial Sequence: Synthetic coding sequence
atgaccatgttacaagagtcgttttcttttgatgacctgtccgtagacttcacccagaaggagtggcagctgctggaccccagtcaaaagaatctctacaaggatgtcatgctcgagaactactccagtctcgtcagcctcggctacgaagttatgaagccagacgttatttttaagcttgagcaaggcgaggagccttgggtgggggatggggaaatcccttcatcagattcccccgaggtctggaaagtggacggcaatatgatgtggcatcaggacaaccaggataaattaaagatcatcaagcgcggtcacgagtgcgatgcatttgggaaaaattttaatttaaacatgaattttgtaccactacgaaagtctaactctgagggagaccttgatggcctgattctgaaacaccaccttgatctgctcatccctaagggtgattatggtaaggcggaatctgacgactttaatgtttttgacaatttctttttgcattctaaacccgaagatacagatacttggctaaagtattacgattgcgataagtacaaggaatcctacaaaaaaagccagatcatcatctaccaccggaatcgactcggcgaaaaactctacgagtgcagcgaatgtcggaaaagattcagcaagaagccttcactcatcaagcaccaaagccggcacatccgagacatcgcttttggctgcggaaattgcggtaagacctttccgcagaaaagccagttcattacacaccaccgcactcacacgggggagaagccatataactgtagccagtgcggtaaggctttcagtcagaagagccagcttacttcgcatcaaagaacgcataccggtgaaaagccatatgagtgcggtgagtgtggcaaggccttttcccgaaaaagccatcttatttctcactggagaacccacacaggcgagaagccttatgggtgcaacgaatgtggacgcgcttttagcgagaagagtaatttgattaatcatcagaggattcatactggggagaaacccttcgagtgtcgcgagtgcggcaaagcctttagccgcaaaagtcaactggtgactcatcaccggacccacactggaaccaagccgtttgggtgttctgactgcagaaaagcattttttgagaagtctgaactgatccgccaccaaaccattcataccggtgagaagccttacgagtgctcagagtgccgtaaagcctttcgggagaggagttccctcatcaaccaccagaggacgcatacaggggaaaaaccccacggttgcatccagtgcggcaaagcatttagccagaaatcacacctcatttcacaccagatgacacataccggtgagaaaccatttatttgcagcaaatgcgggaaggcattctcgcggaagtctcaactggtccgccaccagcggactcatactggggaaaaaccttacgagtgctccgagtgcggtaaagccttttcagaaaaattatctctaaccaatcaccagcgcatccacacaggagagaagccctatgtttgcagcgagtgcggcaaagctttttgtcagaaatcacaccttatcagccaccagaggacacatactggggagaagccctacgagtgttccgagtgtggcaaggcgtttggcgagaagagttcattagctacacatcaaagaacacataccggggagaaaccgtacgaatgccgtgattgtgagaaagcattcagtcagaaaagccagttaaacactcaccaacgaatccacaccggcgaaaagccctatgaatgtagcttgtgtaggaaggcctttttcgaaaagtccgagctaattaggcatttgcgaacacacacaggagagaagccatacgagtgtaacgaatgtcgcaaggcttttcgtgaaaaatcatccttgatcaatcaccaacgcattcacaccggtgagaagccttttgagtgcagtgaatgtggaaaggcgttttctagaaagtcccatctgataccccaccagcgaacgcacactggagaaaagccttacggctgctcagagtgtcggaaggctttttcccagaagtcacagcttgtgaaccaccagagaattcacacgggcgagaagccctaccggtgcatcgagtgcggcaaggcattctcccagaaatcgcagcttatcaatcaccaaaggacccacactgttaagaagtcttag

SEQ ID NO: 25915 - DNA, 210 bp, Artificial Sequence
  Description of Artificial Sequence: Synthetic coding sequence
atgacaatgctgcaggaaagttttagctttgatgatctatccgttgattttacccagaaggagtggcagctgctggacccatcccagaaaaacttgtacaaagacgtgatgttggagaactactcctccttagttagcctggggtatgaagtgatgaagccagatgtgatcttcaaactggagcagggggaggaaccatgggtaggctag

SEQ ID NO: 25916 - DNA, 2217 bp, Artificial Sequence
  Description of Artificial Sequence: Synthetic coding sequence
atgaccatgcttcaagagtctttctcttttgacgacctctctgtcgacttcacccagaaggaatggcagttgctggatccaagtcagaaaaatttgtataaagacgtcatgctggaaaactacagttctctagtgagcttgggatatgaggtgatgaaaccagatgtgatctttaagttagagcagggtgaggagccttgggtcggagacggcgaaatcccgagcagtgatagccccgaagtttggaaggttgacggaaatatgatgtggcaccaggataatcaggataaactgaaaataattaaacgaggccacgaatgtgacgctttcggaaagaatttcaatttgaacatgaactttgtgccgttacgcaaaagcaactcagagggggacctggacggattgatcctgaaacatcacctggatctattaataccgaaaggagactacgggaaggccgaaagcgatgactttaacgtctttgacaatttttttctgcattctaagccagaagatacagacacgtggcttaaatattatgactgtgataaatataaggagtcatataagaaatcccagataatcatctaccaccgcaatcgcctcggggagaagctgtatgagtgctcagaatgtcggaagcgttttagcaagaaaccgagtctcatcaaacatcagtcccgccacattcgggatatcgcgttcggatgcggtaactgtggtaagacatttccccagaaaagccagtttattacgcatcatcgcacccacaccggcgagaaaccatacaactgcagtcaatgcgggaaggctttcagtcaaaaatcccagctgacaagtcaccagaggactcacacgggcgagaagccatatgagtgtggcgagtgtggaaaggccttctctagaaagtcccatctcatttctcattggagaacacatacaggtgaaaagccctacggatgtaatgaatgtggcagggctttttccgagaaatcgaacctgattaatcatcaaagaatccacactggcgagaaacccttcgaatgtagagagtgtggaaaagcatttagccgaaagagccagttggtgactcaccaccgtacccatacagggactaaaccctttggatgcagcgactgccgcaaagcgttttttgaaaaatccgaactgatcaggcatcagaccatccatacgggagagaagccctatgaatgtagcgagtgccgcaaagccttccgggagaggagctctctaattaaccaccaacgcacccacactggtgagaagccgcacggctgtattcaatgcgggaaggccttctcccagaaatcacacctgatcagtcaccaaatgacgcataccggagaaaaaccttttatttgttcaaagtgcggaaaagctttttcccgtaaatcccagctggtgagacatcagcgtacacataccggagaaaaaccctacgaatgctcagagtgtggcaaggccttcagcgaaaagcttagcctcaccaatcaccagcgaatacacaccggggaaaagccttatgtgtgttctgagtgcggcaaggccttctgccagaagtcccacctcatcagccaccaacggactcacactggggaaaagccctacgaatgttctgaatgcgggaaggccttcggtgaaaagagctcactcgctacccatcagaggacacacactggggagaagccctatgaatgccgcgattgtgaaaaggccttctctcagaagtctcagctcaacacacaccagcgaattcacaccggggagaagccgtacgaatgcagtctctgtcgcaaagccttcttcgaaaaatccgagctcattcgccatctgcgcacccatactggtgaaaagccttacgagtgcaacgagtgtcgtaaggccttcagagagaaatcatcactcattaaccaccaacgtattcacaccggcgagaagccgttcgagtgctctgagtgtggcaaagccttcagtaggaagtctcatctcattcctcatcaacgcacacacactggcgagaaaccctatggctgtagtgagtgccgcaaagccttctcccagaaatcacaactcgttaaccaccagagaattcataccggtgaaaaaccctaccgttgcatcgagtgtggtaaggcgttcagtcaaaaaagccagctgatcaaccaccaaagaacgcatactgtgaagaaaagctag

SEQ ID NO: 25917 - DNA, 168 bp, Artificial Sequence
  Description of Artificial Sequence: Synthetic coding sequence
atgactatgctccaggaatccttcagctttgatgacctgagcgtagacttcacccagaaagagtggcaattgctggacccatctcagaagaatttgtataaggacgtcatgttggagaactattcttccctcgtgtcacttgggtacgaagtgatgaagccagattag

SEQ ID NO: 25918 - DNA, 2217 bp, Artificial Sequence
  Description of Artificial Sequence: Synthetic coding sequence
atgacaatgctccaggaaagcttttcttttgacgatttaagtgtggacttcacccagaaagaatggcagctgctcgaccccagccagaagaatctgtataaagatgtcatgctcgaaaattacagctccctggtgagcctgggctatgaggtaatgaaacctgacgtaattttcaagctggagcaaggcgaagagccgtgggtgggggacggcgaaatcccttcttctgactctcccgaagtctggaaggtggatggcaacatgatgtggcaccaagataatcaagacaagctgaaaattatcaaaaggggacatgagtgcgatgccttcgggaagaattttaatctgaacatgaatttcgttcctttaaggaagtctaacagcgagggggatctcgatggtctcatcctgaaacaccacctggacctgcttattcccaagggggattatggaaaggctgagagcgacgattttaacgtcttcgataatttctttctgcattctaagcccgaggataccgacacatggttgaaatactatgattgtgataaatataaggagagctataagaaatcacagattattatctatcacagaaaccgtctgggtgaaaagttatatgagtgttctgaatgcagaaagcgcttcagcaagaaaccaagcctgataaaacatcagtcaaggcatattcgtgatatagcctttggatgtggaaactgcggtaagaccttcccccagaaatctcagttcatcactcaccaccgcactcataccggcgaaaaaccctataactgtagtcagtgcggaaaggccttttcccagaagagtcagttaacatcccaccagcgaacccatacaggcgaaaagccttatgaatgtggggagtgcggaaaggccttcagtcgcaaatcccacctcatctcccattggcgaactcacacaggagaaaagccttacgggtgcaatgaatgcggaagggcgtttagcgagaaatcaaacctgatcaatcaccaacgtatacacacaggggaaaagccttttgagtgtagggagtgcggcaaggcattctctcggaaaagccaacttgtgacccaccatcggactcacactggcacaaagccgttcggttgtagtgactgtaggaaggctttttttgagaaaagcgaacttatcagacatcagaccatacacacaggcgagaagccgtacgagtgctccgaatgtcggaaggcgttcagggaaagatccagcctgatcaaccaccaacgtacacacacgggagagaagcctcatggctgtatccagtgcggaaaagcattctctcagaaatcacacttgatcagccaccagatgacccacaccggagaaaagccctttatctgctccaaatgcggcaaggccttcagtcgcaagagccagctggttagacatcagcgcacacacactggagagaaaccgtacgagtgttcggagtgcggaaaggcattcagcgaaaaattgagtctgacaaatcaccagagaatccataccggagagaagccttacgtttgctccgagtgcggtaaggccttctgccagaaatcgcacctaatttcccatcagcgcactcacaccggtgaaaagccatatgaatgttcggaatgcggcaaggctttcggtgagaagtcgtcacttgccacacatcagagaacgcataccggcgaaaaaccctacgagtgccgcgactgcgagaaggctttttctcagaaaagccagctgaatacacaccagagaatccataccggagaaaagccatacgaatgttctctatgccgcaaggcattctttgaaaagtctgagcttattagacatctgcgtacccacacgggcgaaaaaccctacgaatgcaatgaatgtcgaaaggctttccgcgagaagagctctctaattaaccaccaaagaatccataccggcgagaagcccttcgagtgtagcgaatgtggcaaagcattctcacggaagtcacatctgattccccaccagaggactcacacgggagagaagccttacggctgtagcgaatgccggaaggccttttcacagaagtcccaactggtgaaccatcagcggatacacaccggagagaagccatacagatgtatagagtgcgggaaggctttttcacagaagagccagctcattaatcaccagcgcacacatactgtgaaaaaaagttag

SEQ ID NO: 25919 - DNA, 711 bp, Artificial Sequence
  Description of Artificial Sequence: Synthetic coding sequence
atgacgatgctgcaggagtctttctccttcgacgatctgtccgttgattttacccagaaggagtggcagctgctggatccttcccagaagaacctgtacaaggacgtgatgcttgagaattatagctctctggtatccctcggctatgaggttatgaaaccggatgtcatttttaaactggagcagggggaagagccctgggtgggggacggggagataccttcatctgacagccctgaagtgtggaaagtggatggaaatatgatgtggcatcaggacaaccaggacaaattgaagatcataaaaaggggccatgagtgcgacgcgttcggaaagaactttaatttgaacatgaatttcgtgcccctgcggaaatcgaactcagaaggagatttggatggacttatactcaaacatcatctggatctgcttatccctaagggtgattatggaaaggccgagtctgatgactttaacgtttttgataatttctttctgcattccaaacctgaagatactgacacctggttgaagtactatgattgtgataagtacaaggagtcctacaaaaagagtcagataatcatttatcaccgtaacagactgggagaaaagctttacgagtgcagtgagtgtcggaagagattttcaaaaaaaccaagcctgatcaaacatcaatctcgccacatcagagacatagcctttggttag

SEQ ID NO: 25920 - DNA, 204 bp, Artificial Sequence
  Description of Artificial Sequence: Synthetic coding sequence
atgaccatgctccaggagagtttctccttcgacgacctgtctgttgactttacccagaaggaatggcagctcctagacccctcccagaaaaatttgtataaagacgtcatgttggagaactactcttccctggtctctttaggatatgaggtgatgaagccagatgtgatctttaagctggaacagggagaggagccttggtag

SEQ ID NO: 25921 - DNA, 237 bp, Artificial Sequence
  Description of Artificial Sequence: Synthetic coding sequence
atgacaatgctacaggagtcctttagctttgacgatctcagtgtggattttactcagaaggagtggcagttacttgacccttcccagaagaacctttacaaggatgtgatgctggagaactattcttcactcgtgtccctgggctacgaggtgatgaagccagacgtcatctttaaactggagcagggcgaagagccctgggtcggtgatggagagattcccagctccgactcttag

SEQ ID NO: 25922 - DNA, 2214 bp, Artificial Sequence
  Description of Artificial Sequence: Synthetic coding sequence
atgacaatgcttcaagagtccttctcttttgacgacctgtccgtagacttcactcagaaagagtggcagctgctcgacccaagtcagaagaacctatacaaggatgtgatgttagagaattactcgagcctggtgagtctgggatacgaggtcatgaagcctgatgtgatcttcaaactcgagcagggagaggagccttgggtcggagacggtgaaatcccatcaagtgatagtccagtgtggaaagtcgatgggaacatgatgtggcaccaggacaatcaagacaagctgaagatcataaagcgaggtcatgagtgtgacgctttcgggaagaactttaatctgaacatgaattttgtgccacttcggaaatccaatagtgaaggcgatctcgacggcctgatcctgaagcatcatctagacctgctgattcctaaaggggactatggcaaggctgaatcggacgactttaatgttttcgataattttttcctccattccaagcctgaggacacggatacatggctgaaatactatgactgtgacaaatataaggagtcttacaagaagagccagataatcatttaccataggaataggctaggggaaaaactgtacgagtgtagcgagtgccgcaaaagatttagtaagaagccttcacttataaagcaccaaagtagacacattcgcgatatagcctttggatgtggcaattgtggcaagacatttccacaaaagagccagtttatcactcaccatcggacacacaccggagaaaagccctataattgtagtcagtgtggcaaagcgttctcccagaaatctcagttgacgagtcaccagagaacccacactggcgagaagccatacgagtgtggcgagtgtgggaaagcgttctcccggaagtcacaccttataagccactggcggacgcacacgggcgaaaagccgtacggatgtaacgagtgtgggcgtgcattctcagagaaaagcaacttgatcaaccatcaaaggatccataccggtgaaaagcccttcgagtgtagagagtgcggcaaagcattttctagaaagtcccagctggtcacacaccatagaacgcacacaggaacgaaacctttcggatgtagcgactgccgaaaggcttttttcgaaaaaagcgagttgataagacaccaaaccatccacactggcgagaagccctatgagtgctccgagtgtcgtaaggccttccgtgagcgctctagcctgatcaatcatcagcggacccacaccggcgaaaagccccatggttgcattcagtgcggaaaagcattctcccaaaagtcccacttaattagccaccaaatgacacataccggagaaaagccatttatatgctctaagtgtggcaaagcattctcgcgaaagtcccagctagtcaggcaccagcggactcacactggcgaaaagccttacgagtgttccgaatgcggcaaagcattctcagagaagttaagcctgacaaatcaccagcgcatccatacaggcgagaagccctatgtgtgctcggagtgcggtaaagccttttgtcagaagtcccatttaatcagtcaccagcgcacacacacaggagagaaaccctatgaatgtagcgagtgtgggaaggcctttggggagaagagttcgttagctacacatcaaagaacccatacgggtgagaagccctatgaatgtagagattgcgaaaaagctttttcccagaaatcccaactcaacacccatcaacggatccacactggagagaaaccatacgaatgcagcctttgtaggaaggccttttttgaaaagagtgaattgattcgccacttaagaacccacaccggtgagaagccgtacgaatgtaacgagtgccggaaagcttttcgggagaagagtagcctcataaatcatcagagaatccacacaggtgaaaaaccgttcgagtgctcagagtgcgggaaggcgttcagcaggaaatctcacctgatcccacaccagaggacgcacactggagagaaaccctatgggtgcagtgagtgtcgaaaagctttctcccagaagagccagctggtgaaccatcagcgtatccacacaggtgagaaaccttatcggtgcatcgagtgcggtaaggcattcagccaaaagtctcagttaattaatcaccagagaacccacactgtcaagaagtcatag

SEQ ID NO: 25923 - DNA, 21 bp, Artificial Sequence
  Description of Artificial Sequence: Synthetic coding sequence
atgactatgctgcaggtctag

SEQ ID NO: 25924 - DNA, 1503 bp, Artificial Sequence
  Description of Artificial Sequence: Synthetic coding sequence
atgctagagggtcacgaaagttatgacacagaaaacttttatttccgcgaaatacggaagaatctccaggaggtcgattttcagtggaaagacggcgagattaactataaggagggcccaatgacacataaaaacaatttaactggccagcgggtcaggcactctcagggcgacgtggagaataaacatatggagaatcagctgatcctgcgcttccaatccggtcttggggaactacagaaatttcaaacggcggagaagatctacgggtgcaaccagatcgagcgcaccgtgaataactgtttcctcgcaagcccactgcaaagaattttcccaggagttcagacgaacatctctcgcaagtacggcaatgatttcttgcagctttccctgccaacgcaagacgagaagactcacataagagaaaagccttacatcggcaacgagtgtggaaaagcgttccgcgtgagtagcagcctgataaatcaccaaatgattcatacaacagaaaaaccctaccgctgcaacgaatcgggaaaagctttccacaggggaagcctgctgaccgtgcaccagattgtacacacccgaggaaagccatatcagtgtgatgtgtgtgggaggatctttaggcagaactctgacctagtcaaccaccggagaagccatactggagataagccttacatttgtaatgaatgtgggaaatctttttcaaagtctagccatctagctgtgcatcaacgcatacacacaggcgagaaaccctacaaatgcaaccgctgtggaaagtgcttcagccagagctccagcctcgccacccatcaaactgtacacactggcgataagccatataaatgcaatgaatgcggcaaaacattcaagcgaaacagtagtctgactgcacaccacattattcacgcaggcaagaagccttatacctgtgatgtatgtggtaaggtgttctatcaaaacagtcagttagtcaggcaccaaatcatccataccggcgagaccccttataaatgtaacgaatgtgggaaggtattcaggtaccgatccggcctggccagacactggtcaattcacactggcgagaagccttataagtgcaatgaatgcgggaaggcgttcagagtaagaagcattctactcaatcatcaaatgatgcacaccggtgagaaaccttacaagtgcaatgagtgcggcaaggcatttatcgaaaggtccaatttagtctaccaccagaggaaccataccggggagaagccttataaatgcatggaatgtggtaaagcattcggccgtcgctcctgcctgactaagcatcagaggatccactccagcgaaaagccttataagtgcaacgaatgtggtaagtcatatatatcccggagcgggctgacgaagcaccagatcaagcatgccggagaaaatttgacaaccaagctgaatgtagagcgcccactcgatgtagttctgacctcaggcatccctaaatag

SEQ ID NO: 25925 - DNA, 2775 bp, Artificial Sequence
  Description of Artificial Sequence: Synthetic coding sequence
atggctctgccgcaaggaagcttaacattccgcgacgtcgcggtggagtttagtcaggaagaatggaaatgtcttgacccagttcaaaaggccctgtaccgcgacgtaatgttagagaactacagaaatctgggtttcttgggcctgtgcctgccagatctgaacatcatctcgatgttggagcagggtaaggagccttggacggttgtttctcaggtaaaaattgcccgaaaccccaattgtggcgagtgtatgaagggcgttatcacaggtatcagtccaaagtgtgtcatcaaggaattgccgcctatccagaattcaaacacaggcgaaaaatttcaggccgtgatgttggaaggtcacgagtcctatgataccgaaaacttctatttccgtgagatcaggaagaatctgcaggaggtggattttcagtggaaggatggcgagatcaattataaggaggggcctatgacgcacaaaaacaacctgactgggcaacgagtccgacattcccaaggagacgtagagaacaagcacatggagaaccaactcatactcagattccagtctggattaggggaactgcaaaaattccagacagctgagaaaatttacgggtgcaaccagatcgaaagaacagttaacaattgcttcctggccagtcccctgcagagaatcttccctggggttcagactaacatcagcaggaagtacggcaacgactttcttcagctcagtttgcctacccaagatgaaaaaactcatattcgcgagaagccgtacatcggcaatgaatgcggcaaagccttcagagtgtctagctccctcattaaccatcagatgatccacactaccgagaaaccatacaggtgcaacgaatctgggaaggcattccatcgtggttccctgttgacagtgcatcagatcgtgcacactagaggcaagccctatcagtgtgacgtctgcggcagaatctttaggcagaatagtgatctggtgaatcatcgaagatcccatacgggcgataaaccgtacatctgcaacgagtgtggcaagtcattttctaagtcaagccatctcgctgtgcaccagcggatacataccggcgagaagccatacaagtgcaacagatgcggaaaatgcttcagccaaagctctagcctcgccactcaccaaacagtgcacactggagacaaaccgtacaagtgtaacgagtgcggaaaaaccttcaaacgaaacagcagcctgactgctcaccacataatacacgctggtaaaaaaccttacacctgtgatgtgtgtggtaaggttttctaccagaacagccaactcgtgaggcaccagatcatccacaccggcgaaaccccttacaagtgcaatgaatgcgggaaggtgttctttcagcggtcgagactcgccggacaccgccgtatccacacaggcgagaaaccatataaatgcaatgagtgtggcaaggtattcagtcagcactcccatttggcagtgcaccagcgggtgcatacaggggagaagccctataagtgcaacgagtgtgggaaggcctttaactggggatccctcttgaccgttcatcagcgaatccatacaggtgagaaaccgtacaaatgtaatgtgtgtggcaaggtttttaattacggcggttatctgtccgttcacatgagatgtcatacgggcgaaaagcccttacactgcaataagtgtgggatggtgttcacttattacagttgtctggccagacatcaaaggatgcatacaggcgagaaaccctataaatgcaatgtgtgcggtaaggtgttcattgactctggcaatctatcaattcaccggcgttcccacacgggcgagaaaccctttcagtgcaacgagtgtggcaaagtattttcatattactcctgcttggccagacaccgcaaaattcacaccggggagaaaccctacaaatgtaatgactgcgggaaagcctatacacagcggtcctcacttacaaagcacctcgttatacatacgggtgaaaacccttatcattgtaacgaattcggcgaagcatttattcaatcctccaagctggcccgatatcaccgaaacccgactggcgaaaagccgcacaagtgctcagagtgcggccgaactttctcacataagacatccctcgtttatcatcaaaggagacatacaggggagatgccctataaatgcatagaatgtggcaaggtctttaattctacaacaacgctagccagacataggcgcatacataccggagaaaaaccttacaaatgtaatgaatgtgggaaagtctttagataccgatctggtctggcccgtcattggtccatacacactggtgaaaagccctacaagtgcaacgaatgtggcaaagcattccgcgttagatcaatactgttgaatcatcaaatgatgcataccggcgaaaagccttacaaatgcaacgagtgcggaaaagccttcattgaaagatccaatcttgtctatcaccagcgcaatcacaccggggagaagccttacaagtgcatggaatgcggaaaagcttttgggaggaggtcttgtctcaccaaacaccagcgcatccatagctctgagaagccctataagtgtaatgaatgcggaaagtcatatatttctcgatccggcctgaccaagcatcagattaaacatgccggagagaaccttaccactaaactgaatgtggaacgaccattggacgtggttctgacaagtggcatacccaagtag

SEQ ID NO: 25926 - DNA, 2427 bp, Artificial Sequence
  Description of Artificial Sequence: Synthetic coding sequence
atgttggagggacacgagagctatgacaccgaaaatttttatttccgggaaatcaggaaaaaccttcaggaggtcgattttcaatggaaggatggcgagatcaactataaagaaggtccaatgacccataagaacaacctgactggacagagggtgcgacactctcaaggcgatgtggaaaataagcatatggagaatcaactgattctccggtttcagtcgggcctgggcgaactgcagaagtttcagacagcagaaaaaatttacggctgtaaccagatcgaacggactgttaacaattgtttcctggcctcacccctccagcggatattcccaggagtccagaccaacatcagtcgaaagtacggtaacgatttcctgcagttgagcctgcccacacaggatgaaaaaacacatatacgggaaaaaccatatataggcaatgagtgtgggaaagcatttcgggtcagctcctccctgattaatcatcaaatgattcatacaacggaaaaaccgtatcgctgcaacgaatctggcaaagcctttcaccgcggttctctcttgaccgtccatcagattgttcacacgaggggtaagccctatcagtgtgatgtgtgcggtagaattttccgccagaacagcgacctggtgaatcacaggagaagtcacactggcgataagccttacatctgtaacgagtgcggcaagtcgttctctaaaagctcacatctggccgttcatcaaaggattcacaccggagaaaagccctacaagtgcaatagatgcggtaaatgttttagccagtcctctagtctggctactcatcaaactgttcacacaggggataagccatacaaatgcaatgagtgcggtaagacatttaagcgtaattcctcattaacggcccatcacatcatacacgctggaaaaaaaccttatacatgtgatgtctgtgggaaagttttctatcagaactcccaactcgtcaggcatcagatcatccatactggagaaacaccgtacaagtgtaatgagtgcggtaaagtgttcttccaacgctcccgccttgctgggcatcggagaatccatacgggagagaaaccatacaagtgtaacgaatgcggaaaggtgttcagccagcactctcacctcgcagtgcatcagcgggtgcatactggcgaaaagccttataagtgcaacgagtgcggcaaggcgtttaattggggctctctgctgaccgtgcatcagagaatccacaccggggaaaaaccatataaatgcaatgtttgcggaaaagtctttaattatgggggatatctgtctgtccacatgcggtgccatacaggtgagaagccattacattgcaacaagtgcggcatggtgtttacatattattcgtgcctggcccgtcaccagaggatgcataccggtgagaaaccctacaaatgcaacgtgtgcggcaaggttttcatcgattctggaaacctgtcaatacaccgacgatctcataccggtgaaaagccattccagtgcaacgagtgtgggaaggtgttctcatattactcttgcttggcaagacacagaaaaattcataccggagagaagccctacaagtgtaacgattgcggcaaagcatatactcagcgcagcagtctcaccaaacacctggtaattcatacaggtgagaatccttaccattgcaatgaattcggcgaagcgttcatccaatcctccaagcttgctagataccatagaaatcccaccggcgagaagccccataagtgcagcgagtgtgggagaactttttcgcataagactagcctggtgtatcatcagagacgacacactggtgagatgccctacaagtgcatcgaatgtggtaaagtgttcaactccaccacaaccctggcacggcatagacgcatacataccggcgagaagccctacaagtgcaatgaatgtggtaaagtgtttcggtacagatccggtctggctagacattggagcatccacacgggggaaaagccatataagtgtaacgagtgtggcaaggcatttcgcgttcggtcaatcctcctgaaccaccagatgatgcatacaggtgaaaagccctataaatgcaacgagtgcggcaaggcttttatcgagaggtccaacttggtgtatcatcaaagaaaccataccggggaaaagccgtacaaatgtatggagtgcggtaaggcatttggccgtaggagctgcctgaccaaacatcagcgaattcattccagcgaaaaaccgtacaagtgtaacgaatgcggaaaatcctatatctctcggtcaggcttgacaaaacaccaaatcaagcacgcgggagagaacctgacgacaaagctgaacgtggagcggcctctggacgtagtgttgacatccggaatccctaagtag

SEQ ID NO: 25927 - DNA, 2001 bp, Artificial Sequence
  Description of Artificial Sequence: Synthetic coding sequence
atggatctcgttgcttttgaagacgttgccgtaaacttcacccaggaggagtggagcttgcttgaccctagtcagaagaacttatacagggaagtgatgcaggagacacttcgcaatctcgcatccatcggcgagaaatggaaggatcagaacatcgaggatcagtataaaaacccacgaaacaacttgcgcagtctgttaggtgagcgcgtggatgagaatactgaggagaatcactgtggcgagacgtctagccagataccggatgataccttaaacaaaaagacctcgcccggtgtgaagagctgcgagtctagtgtgtgcggcgaggtattcgtaggacatagtagcttaaacagacatatccgcgcagacacagcccataagccctctgaatatcaggaatatggacaggagccctacaaatgtcagcagcgcaaaaaagcttttcggtgccatccttcatttcaaatgcaggaaaaggcacataccggcgagaaactatacgattgcaaagaatgcggcaaaacattcatcagccatagttcaatacagcggcacatgataatgcacaacggggacggcacttacaaatgtaagttttgcgggaaagcctgcccttgtttgtcgatctatcttatccacgagcgtgtccataccggagagaaaccctataagtgtaaacaatgtgggaaagccttcagttatagcacctccctccagattcatgagaggacacacacgggggagaagccttatgaatgtaaggagtgcggcaaagctttcggtagccccaacagcctctacgaacaccgcaggacacacaccggcgagaagccctacgaatgtaagcaatgcgggaaggccttccggtggttccatagctttcagatccacgagagaacccatagtgaagaaaaggcttacgagtgcacaaaatgcggcaaagccttcaagtgtccgagctacttatgtcgtcacgaagtgactcactccggcaaaaagccttgcgaatgtaagcaatgtggcaaagcgctgtcgtatctgaattttcagcggcacatgaagatgcatacccggatgcgcccttacaagtgcaagacagtggaaaagcctctgattctgccggtgaggttcgaggatatgaaggagctgacattggaaagaaatcttatgaacgcatcaactgtcgtcaaaccttcaatcgtccccgtgccatttaccatcatgaaagggctgaccttagaacgcaacccaatgaatgtgagctctgtggtgaagccctctttcctgccactgccgttcgacatcatgaagggcttaacccttgagcggaatagaatgtccgtttctaacgttggcaaaccatcggatctccctcatacttttaagtgtatggagggactaaccttaaagaggaaccccatgaatgtgagcagtgtggtaaaaccatcgttcttccccctccctttcgacataatgaagggcttaacgctcgagaggaatccaatgagcgtctcaaacgtggggaagccaagccacctgccacacacattcaagtgcatgaaaggcctcaccctggaaagcaattgcatgaatctgaacaacgttaagaagcctctcgacctgagcgaaacttttaaatttatgaaacggcacacactggaaaggaacccaattcgcaatatggagaagcactcaacaatctctctgccttttaaatatatgcagcagtgtaccgaggataggatgcccatgaacgtcaagtcagtcacgaagcactcatacctgcctcgatcctttgagtacatgcaggagcacacactggagcgcaatcctatgaacgtgagaaatgctgagaaacgatctattatattcctgctctgcgtgtatacaaagggatgcaccctggaacggaatcatattaatgtaaggatcgtggggaaacatagtgtgtgcctggtgccgtttgtggatattaagggtctcacgctcgaatag

SEQ ID NO: 25928 - DNA, 1035 bp, Artificial Sequence
  Description of Artificial Sequence: Synthetic coding sequence
atggacctggttgccttcgaggacgtagcggttaatttcactcaagaggagtggagtcttctcgacccaagccaaaaaaacctttatcgggaagtgatgcaagagactctccggaaccttgcatccattggcgaaaagtggaaggatcaaaatatagaggatcagtataaaaacccacgcaacaacctgagaagcctactgggcgaacgggtggatgaaaatacagaagaaaatcactgtggcgagacatcctctcagatccccgacgataccctgaacaagaaaactagccctggcgttaaaagctgcgagagtagcgtctgtggggaggtgtttgtggggcactctagtctgaataggcatattcgcgctgacacttgccacccttcattccagatgcaagagaaggcgcatactggcgaaaagctgtacgactgcaaggagtgtgggaaaaccttcatctcacactcatcaatccagcgtcacatgattatgcacaacggggatggaacgtataagtgtaaattctgcggaaaagcatgcccctgcctttctatatatctcatccatgaacgtgtccatacgggagagaagccctacaaatgcaaacaatgtggcaaagccttcagctattccaccagtctacagatacacgaacgcactcacaccggggaaaagccctacgagtgtaaggagtgcggcaaggcctttggctcgccaaacagtctctacgagcaccgacgtacgcacacaggggagaagccgtatgaatgcaagcaatgcggaaaagcttttagatggttccattcgttccagatccatgagagaacacactctgaagaaaaggcctacgaatgcacaaagtgcggcaaagctttcaaatgtccaagctatttgtgccgtcacgaagtgacccatagcgggaagaagccgtgcgagtgtaaacaatgtgggaaagcgctgagctatttaaatttccagcgacacgaaagaacacacacaggggagaaaccttacgaatgcaagcactgttag

SEQ ID NO: 25929 - DNA, 1578 bp, Artificial Sequence
  Description of Artificial Sequence: Synthetic coding sequence
atggaccttgtggccttcgaggacgtcgccgttaactttacgcaggaagagtggtcactgttagaccccagccagaagaacctataccgggaagtcatgcaggagacgctgaggaatctggccagcatcggcgaaaaatggaaggaccagaatattgaagaccaatacaaaaaccccaggaacaacctcaggtctcttctgggcgagcgcgttgacgagaacaccgaggaaaaccactgcggagaaacctccagtcagatccctgacgacactttaaacaaaaagacatctccaggggtaaagtcatgcgagagtagcgtgtgtggtgaagtttttgtgggccattcttcccttaatagacatatccgcgcagataccgctcacaaaccctctgagtatcaggaatatggtcaggagccctacaaatgccagcaaaggaagaaggccttccgctgtcaccccagtttccagatgcaggaaaaagcgcataccggagagaaactctatgactgcaaggagtgcgggaaaacctttatttcccacagcagcatacagaggcacatgatcatgcataacggagacggtacctacaaatgtaagttttgcgggaaggcatgtccatgcttatctatttatctgattcatgagcgggtccataccggtgaaaaaccatacaaatgcaagcagtgtggtaaggcgttctcatactccaccagtctacagattcacgaaagaacccacaccggtgagaaaccctacgaatgtaaggagtgcggcaaggctttcggttctcccaatagcctgtacgagcaccgacgcacacacactggtgagaagccatatgagtgtaaacagtgtggcaaagcattcaggtggtttcattcctttcagattcatgagaggacgcattcagaggaaaaggcctatgagtgtactaaatgtggaaaagcgtttaaatgcccaagttatctctgcagacacgaagtcactcattccggaaaaaagccctgcgagtgcaaacagtgcggaaaagccctgagctacctcaacttccagcgtcacatgaaaatgcacactcgcatgcgaccctataaatgtaaaaccgttgagaaacccctcatcctgcccgttagatttgaggacatgaaagagcttaccctcgaaagaaacctcatgaacgcttccaccgtcgtgaagcctagtattgtcccagtgccctttaccataatgaagggtctcaccctggaacgaaatcctatgaacgtgagtagtgtcgtaaaaccctctttcttgcccctgccctttgatattatgaaagggctcactctggaaagaaaccgtatgagcgtgagcaacgttggaaagcctagcgacctcccccatacattcaagtgcatggagggattaacactcaagaggaacccgatgaacgtgtcttccgtcgtgaagccctcttttttcccactgccttttgacatcatgaagggattgacactagagagaaatccaatgagtgtgagtaacgtcggtaagcctagccaccttccccacacattcaagtgcatgaaaggccagtag

SEQ ID NO: 25930 - DNA, 183 bp, Artificial Sequence
  Description of Artificial Sequence: Synthetic coding sequence
ctctcactgcctcaggggctgctcacattccgagacgtagccatcgagttctcccaagaggaatggaaatgcttggaccccgctcagcgcaccttgtacagagacgttatgctggagaactatagaaacctggtgtccctgggctcgtcagcagtctgcgatctggggtcgccccaaccctag

SEQ ID NO: 25931 - DNA, 2661 bp, Artificial Sequence
  Description of Artificial Sequence: Synthetic coding sequence
atggcgctctcgcagggacttctgacctttcgagacgtcgcaatcgagttctctcaggaggaatggaagtgtctggatccggctcagcgcactctctaccgcgatgtgatgctggagaactatcgaaatcttgtttccctggatataagttcaaagtgcatgatgaaagagttttcttccaccgcccagggcaacaccgaggtcattcacacaggtactcttcaacggcacgaaaggcatcacattggggacttttgctttcaggaaatggagaaggatattcacgacttcgagtttcagtggaaggaagatgagcgaaactcccacgaggcacccatgacagagatcaagcaactgactggctcaacaaaccggcatgaccagcgtcacgcgggaaacaagcctatcaaggatcagcttggctcttccttccatagccatctccccgagcttcacatgtttcagacggaggggaagatcgggaaccaagtcgaaaagagtataaatagcgcctcacttgtgtcgacaagtcagcgcattagctgtcgtccaaagacgcacatttccaagaattacggaaataactttttaaatagttctctgctgacgcagaagcaggaagtccatatgagggaaaagtcttttcagtgcaacgaatccggcaaagcctttaactattcgtccgtgctacgaaaacaccagatcattcatctgggcgcaaagcagtataaatgtgatgtgtgcgggaaggttttcaaccaaaagagatatttggcctgccatcggcgatgccataccgggaagaagccctacaagtgcaatgattgcgggaaaacattcagtcaggagctcacacttacttgccatcatcgcctacataccggcgagaaacattacaagtgctccgaatgtgggaagactttctctaggaactcagccctggtgatccataaggcgatccatactggtgaaaagagctacaaatgtaatgagtgcggtaagacattctctcaaacctcatacctggtttaccatagacggctgcacaccggtgagaagccatacaagtgtgaggagtgcgataaggctttctcattcaagtcaaatcttgaacggcaccggaaaatccataccggagaaaagccctataagtgcaacgaatgttcccgtaccttcagcagaaaaagctcacttacacgccacagaagactgcacacaggtgaaaaaccctacaaatgcaacgactgtggaaaaacattctcacagatgtcctctctggtgtatcatcgtaggcttcatacaggagagaaaccatataaatgcgaagaatgcgatgaggcattctcgttcaagagcaatctggaaagacaccggagaatccacacaggggagaaaccttataaatgtaatgattgcggaaaaaccttctcacagaccagcagcctggtctatcaccgccgtctccacacgggggaaaaaccttacaaatgcgaagagtgcgacgaagccttcagtttcaagtccaacttggaacggcatagaatcattcacaccggagaaaagctgtacaaatgtaacgaatgtgggaaaacattctctagaaaatcttcgctgacccgccactgcaggctacacactggcgaaaaaccataccagtgtaatgaatgcgggaaggcattcagggggcagtctgcccttatctaccatcaggcgattcacggcatcgggaagctgtataaatgcaatgactgccaccaagtgttctccaatgcaacgaccattgcaaaccactggagaatccataatgaggaacggtcctacaagtgtaatcgatgtggtaaattcttcagacacagatcgtatctggctgtgcattggaggactcatagcggcgaaaaaccatataagtgtgaggaatgtgatgaggcgttctcattcaagtcaaacctgcagcgacataggcgtatccataccggggagaagccttacaaatgtgaggaatgcgacaaggtgttcagccgcaaatctagtctagagaagcataggcgcatccatacaggcgagaaaccatacaagtgcaaagtgtgcgacaaagcctttggcagagatagccatctagcgcagcacactcggatccatacaggtgagaaaccttacaaatgcaacgaatgcggtaagaacttccgccacaacagtgctctggtcatccacaaggccatccactcaggagaaaaaccatacaagtgtaatgagtgtgggaaaacatttcgccacaattcagcactggagattcataaagctatacacacaggcgaaaagccttacaaatgctctgagtgcggcaaagtctttaatcgcaaagctaatctctccagacatcacagactgcatactggagagaaaccctacaagtgcaacaaatgcggcaaagtctttaaccagcaagcccaccttgcttgtcaccatagaatccacaccggcgaaaaaccttacaaatgcaacgaatgcggtaagacttttcgacacaacagcgtgttggtcatccataagactatccataccggagagaagccctacaaatgtaacgagtgtgggaaagttttcaatcggaaagccaagctggcaagacatcaccggatccacacaggcaagaaacactag

SEQ ID NO: 25932 - DNA, 2913 bp, Artificial Sequence
  Description of Artificial Sequence: Synthetic coding sequence
atggcactgtctcaaggcctcctcacttttcgggatgttgcgatcgaattttcccaagaagaatggaaatgcctggatcctgcgcagcggaccctgtaccgggatgtgatgctggaaaactacaggaacctggtgtctcttgatatcagcagcaaatgcatgatgaaggagttctcctctaccgcacagggaaataccgaggtcattcatacaggtacccttcagagacatgaacgccatcacattggcgatttttgtttccaggaaatggagaaggacatccatgattttgagttccagtggaaggaggatgagcgcaatagtcacgaggctccaatgaccgagattaagcagctcaccggcagcactaaccggcatgaccaaagacatgccggtaataagcccattaaggatcaactcgggtctagtttccacagccacctgccagagctccacatgtttcagacagagggaaaaataggaaaccaggtagagaagagcatcaatagcgccagccttgtcagcacatcccaacgcatcagctgtcggcctaagacccacatttcaaaaaactacgggaacaacttcctcaactccagcttactaacacagaaacaagaagtgcacatgcgggaaaagagtttccagtgtaatgagtccgggaaagcttttaactactctagtgtactccgcaagcatcaaattatccatctcggcgcaaaacagtataaatgtgatgtgtgcggcaaggtcttcaatcagaagaggtaccttgcatgtcaccgacggtgccatactggaaaaaagccatacaagtgcaatgactgcggcaagacgttctcccaggaactcactctcacctgtcaccataggctgcacacgggtgaaaagcattacaaatgttccgagtgtggcaagaccttcagccgaaatagcgcactcgtgatccacaaggcaattcataccggtgaaaagagctataagtgcaacgagtgtggcaagaccttctcgcagactagctaccttgtgtatcaccgcagactgcataccggagagaaaccatataaatgcgaggagtgcgacaaggcattttcctttaaaagcaatcttgagagacatcgcaagatccacaccggcgagaaaccatacaaatgtaacgagtgctctcggaccttcagcaggaagagcagtcttacacgacataggagactgcatacgggcgagaagccctacaagtgtaacgattgcggaaaaacattcagccagatgagtagtctggtataccaccgaagacttcatactggagagaagccgtacaaatgtgaggagtgtgatgaagcattttcctttaaaagcaatttggaaagacaccggaggatacataccggagagaaaccctataaatgtaacgattgtggcaagaccttctcacaaacctcatctttggtgtatcaccgacggctgcatacgggagaaaagccttataagtgcgaggagtgtgatgaggcgttcagcttcaaatcaaatctagaacgccatcgtataatccacacaggggagaagctgtacaagtgtaatgaatgcgggaagaccttctcgaggaaatcatcgctgaccaggcactgccggctgcacactggtgagaaaccgtatcagtgtaacgagtgcggcaaggcgttcaggggacaaagcgccctgatctaccatcaggcaatccacggaatcggcaaattatataaatgtaatgactgccaccaagtgttttctaacgcaacaacgatcgccaatcattggagaatccataacgaagagaggtcttataaatgtaacagatgtggcaagtttttcaggcataggagttacctggcggtccactggcgaacccactcaggtgaaaaaccatacaagtgtgaggaatgcgacgaggcattctcattcaaatctaacctgcaacgacatagaaggattcataccggtgagaagccataccggtgcaacgagtgtggcaaaacattttcccggaagagttacctgacctgccacaggcgcctccatacgggtgagaagccatataaatgcaacgagtgcggtaaaactttcgggcgaaactccgcactgataatacacaaggccatccataccggtgagaagccttacaagtgcaacgagtgtggcaaagcattctcgcagaagagtagcctgacctgccacctgagactccatactggagagaagccctacaagtgtgaggaatgcgataaggtgtttagtcggaaatcctccctggaaaagcatcgcagaattcacaccggtgaaaagccctataagtgcaaggtgtgcgataaagcattcggccgagatagtcacctggcacagcacacaagaattcacaccggagagaagccttataaatgcaatgagtgcggtaaaaatttcaggcacaatagcgccttggtcattcataaggccatccactcaggtgaaaagccttacaagtgcaacgagtgtggtaagacgtttcgccataatagcgcgctggagatccacaaagccattcacacaggtgagaagccatacaagtgctctgaatgtggcaaggtgttcaatagaaaagcgaatcttagtcgccaccaccggctgcacaccggtgagaagccctataaatgcaataagtgcgggaaagtgtttaatcaacaggcgcatctggcctgccaccacaggatccacactggagaaaagccttataagtgtaacgaatgtggaaaaaccttcaggcacaactctgtgttggtgattcacaaaacaattcataccggtgaaaagccttacaaatgcaacgagtgtggtaaggtgttcaataggaaagcgaagctcgctcggcaccatcgtatccatactggaaaaaaacattag

SEQ ID NO: 25933 - DNA, 1602 bp, Artificial Sequence
  Description of Artificial Sequence: Synthetic coding sequence
atggactcttctcagcatctggtgacattcgaggacgtggcagtggattttacacaggaggagtggactctgctcgaccaggctcagagggatctgtatcgagacgtcatgctggagaattataagaatttgattatcctggcagggtccgaactgttcaagagaagcctaatgtccggcctggaacagatggaggagctccggacaggcgtcacgggcgtgctccaggaattggatcttcagcttaagacaaaagggagccctttgttgcaggacatcagcgctgagcgttcacccaatggcgtccagcttgagagatccaacaccgcggagaagctgtacgattctaaccattccgggaaggtgttcaatgaacatccgtttctaatgacacacatgataacccacattggcgagaaaacgagcgaagacaatcagtccggcaaagcgctcaggaaaaacttcccgcacagtttttataagaagtcacatgctgaaggcaagatgcccaaatgcgtgaagcacgagaaggcattcaaccaatttcccaaccttacgcgccagaataaaactcatacacaggagaagctttgtgagtgcaaagactgctggaggaccttccttaaccagagtagtttgaagttacacattcgatcgcataacggggataagcactatgtgtgcaaagaatgcggaaaagcgttttcaaatagctcccacttgatcggacatggcaggatccactcaggcgagaagccttacgtatgcaaagaatgtgggaaagccttcacccagtcaacaggtctgaaactacacatacgcacccactctggtgaaaagccatataaatgtaaggagtgtggcaaggctttcacccacagcagctatttaacggaccacactcgcatacattctggaaaaaagccctatgtgtgcatggagtgcggtaaggctttcacaagatctacagggctgatactgcacatgaggatccacactggggagaagccatatgagtgtaaggagtgcggaaaagcttttattcattcaagttacctcacaaaacatgtgagaatccattctggtgagaagctgtacctgtgcaaggcatgcggaaaagcgtttaccagaagcagcggtttggttctgcacatgcggactcacactggagaaaaaccatacgaatgcaaggagtgtgggaaagccttcaacaatagctcaatgctgagccagcatgtgaggattcatacaggtgaaaagccctatgagtgcaaagaatgcgggaaagcattcacccagagtagtgggttaagtacacatctgaggacccatactggtgagaaagcctgcgaatgcaaggagtgtggcaaggccttcgccagatctaccaatcttaacatgcacatgcggacccataccggggagaaaccctatgcatgcaaggagtgtgggaaagcattcagatactcgacgtacctcaacgtgcacactcgaactcacaccggggctaagccctatgaatgcaaaaaatgcggcaagaactttacacaatcctccgcacttgccaaacatcttagaacgaaggcatgcgagaaaacttag

SEQ ID NO: 25934 - DNA, 1899 bp, Artificial Sequence
  Description of Artificial Sequence: Synthetic coding sequence
atgctcagggaggaggctgcccaaaagcgaaaggagaaagagcctggcatggcgctcccgcaaggccatctgacttttcgggacgtggctattgagttctccctggaagagtggaaatgcttggatcctactcagagagccctctatagagctatgatgttagagaattatcggaatctgcattcagtggacatcagctcaaaatgtatgatgaagaaattcagttcgacagcccaggggaacacggaggtagatacgggaactctcgagcggcacgagtcccatcatattggcgacttttgcttccagaagattggtaaagacatacatgacttcgaattccaatggcaggaggacaaacgaaactcacacgaggctactatgacacagatcaagaagctgacaggctccaccgataggtatgacaggcgccatcccggtaacaaacccattaaggaccagctggggctcagctttcacagtcatcttcccgaactgcacattttccaaacaaaaggaaaggtcggcaatcaggtcgaaaaatctatcaacgacgcttcatctgtgctgactagccagcggattagcagtcgtcctaagatacatatttcaaacaactacgagaataatttctttcacagttctttattgaccctgaagcaggaagtgcacatccgggagaagtccttccagtgtaacgagagcgggaaggcctttaactgtagcagcctgctccggaagcaccaaattatctacctggggggaaagcagtacaaatgtgatgtttgcggtaaagtgttcaatcagaaaagatacctcgcttgtcaccatcgttgtcacaccggagaaaaaccgtacaaatgtaacgagtgtggcaaggttttcaatcagcagagtaacctcgccagccatcaccgtctgcacaccggtgagaagccatacaagtgtgaagagtgcgacaaggtcttttctcggaagagtaacctggagagacatagacgaattcataccggtgaaaaaccttacaagtgcaaggtgtgtgaaaaggcttttaggcgggactcccacctgacacagcacacacgaattcacactggtgagaaaccatacaagtgtaatgagtgcggtaaagcattttctggacagagcacgttaatccatcaccaggctattcacggtatcggcaagttgtacaaatgtaacgactgccacaaggtcttctcaaatgctactaccattgccaatcactggcggatacacaatgaagagagaagttataagtgtaataagtgcggcaagttttttaggcggcgatcgtatctcgtagtacattggcgaacccacacgggcgagaaaccttataagtgcaacgagtgtgggaaaacattccaccacaacagtgctctggttatccacaaagcaattcacacaggcgaaaagccgtacaaatgcaacgaatgtggtaaaacgtttcgccacaactctgccctcgtgatccacaaagcaattcatacgggcgagaagccctacaagtgtaacgagtgtggaaaggtgtttaaccagcaagctactctagccagacaccaccgcctacacaccggtgaaaagccatataaatgcgaggagtgtgacaccgtcttttcacggaagtctcaccatgagactcacaagagaatacacaccggtgagaaaccctacaagtgcgacgatttcgacgaagcattcagccaggcgtcatcatacgcaaagcagaggagaatccacatgggagagaagcatcacaaatgcgatgactgcgggaaagcctttacgagccactctcaccgtattaggcatcagagaatccacactggccagaagtcttacaagtgtcacaagaggggtaaagtgttctcttag

SEQ ID NO: 25935 - DNA, 1122 bp, Artificial Sequence
  Description of Artificial Sequence: Synthetic coding sequence
atgtctcttagacggcacataggaaacccagaatatttaatgaagaggatcccccaaaacccgagataccagcatattaaatcaagactcgacaccggcaactctatgacgaagtacacggagaagctggaggagataaagaagaattaccggtacaagaaagatgagctcttcaaacgtttgaaggtgaccacttttgcacagctcatcatccaggttgctagtttgagcgatcagaccctcgaggttactgccgaagagattcagcgcctggaagacaacgattccgcagctagcgacccagacgcagaaaccacagccaggaccaacggtaaaggaaatcctggtgagcagtccccctcgccggaacaatttatcaacaacgcgggtgccggagattctagcagatcaactctgcagagcgtcatcagcggcgttggagagctggaccttgataaggggccagtaaagaaagctgaaccacacactaaagataaaccctatcccgactgtccattcttactccttgacgtgagagaccgggattcctatcagcagtgtcatatcgttggagcatacagctatccaatcgcgacactaagtaggacaatgaacccctactcaaacgacatacttgagtataagaacgcccatggcaagatcattattctctacgacgacgacgagcggttggcctcacaagcagccacgacaatgtgcgagcggggatttgagaatctgtttatgttgtctggaggtctgaaagtgctcgcccaaaaattccctgagggactaatcaccgggtctctgcccgcatcgtgccagcaggctctccctccaggaagcgcgaggaaaagatcctcacctaagggcccaccgctcccagccgagaacaagtggcgcttcacccctgaagatctgaaaaagatcgaatactacctggaggaagagcagggccctgcagaccaccctagtagactgaaccaagctaactctagcggacgcgaatctaaggtaccgggagccaggagtgcccagaatctgccaggtgggggacccgcatctcattccaacccgaggagcctgagctccggccacctacagggcaaaccatggaagtag

SEQ ID NO: 25936 - DNA, 1692 bp, Artificial Sequence
  Description of Artificial Sequence: Synthetic coding sequence
atggctcggaggctgctgcctgcacatgtacaggaatcggtgacttttagagacgtcgcggtcttctttagtcaggacgaatggttacaccttgactcagctcagagggccctctaccgagaagtaatgctcgagaactactcaatactagtatctctcggaatcctgttctccaagcccaaggtgatctctcagctggaacagggggaggacccatggatggtcgaatccggcgtccctcaaggcgctcatctcggatgggaatcactttttggtaccatcgtgtctaaggaagagaatcaagaggttatgaaaaagctcataatcgacggtaccttcgacttcaagcttgaaaaaacctatattaacgaggacaagctggaaaagcagcagggtaagaaaaaccggctgttctctaaggtcctggtgacgatcaaaaaggtctacatgaaagagcggtccttcaaaggagttgagtttggaaaaaatctcggactgaaaagcagtttaatccgaaagcccaggattgtatcacgtggaagacgcccacgttcccagcagtattccgtgcttttcaaacaactgggcgttaacacagtgagaaaatgctacaagtgtaacatctgtggcaaaatctttctacatagctcttccctctcaaagcatcagagaattcacaccggggagaaactgtataaatgtaaagaatgtcgcaaagcgtttagccagagctcatcgctgacccagcacctgcgagtgcacaccggtgaaaagccgtatatttgctccgaatgtggaaaggcttttagttttactacctccctcataggtcatcagcggatgcatactggcgagcgaccctacaaatgcaaggaatgcggcaaaacattcaagggaagttcatcactcaacaaccaccagaggattcacaccggtgaaaaaccatacaagtgtaatgaatgcggcagggcttttagccagtgctcctccctcatccagcaccacaggatccacaccggtgagaagccatacgaatgtacacagtgcggaaaggcattcacgtccatcagtaggctatctcggcaccataggatccacaccggagagaaaccatttcattgcaacgagtgcggcaaagtgtttagctatcactcagcgctaattattcaccagcgcatccacactggggagaagccttacgcttgcaaggagtgtgggaaggccttctcccagagttcagccctgattcaacaccagagaatccacactggcgaaaagccttataagtgcaacgagtgcgggaaggctttctcatggatttctaggctcaacattcaccaccgtatccacaccggagagaaaccatacaactgcaaagaatgtggcaaggctttttcctcacactctggagttaacactcatcgcaaaattcatacaggagagaagccctacaaatgcaatgattgtgagaaagcgtttaatcagtcctccgctcttatacagcaccagcggattcacactggggaaaaaccgtataattgcaaggtttgtggaaaagcctttcggcagagttctagcctcatgacccacatgagaatccatacaggagaaaagccctacaagtgcaaagaatgtggcaaagccttctctcagtcttctagcctgaccaaccatcaacggacacataattag

SEQ ID NO: 25937 - DNA, 126 bp, Artificial Sequence
  Description of Artificial Sequence: Synthetic coding sequence
atggcacgccgtctgttgcccgcacacgtgcaggaatctgtcacgtttagggacgtggcagtttttttttcccaggacgaatggcttcaccttgactcagctcagagggctctgtatagggaatag

SEQ ID NO: 25938 - DNA, 405 bp, Artificial Sequence
  Description of Artificial Sequence: Synthetic coding sequence
atggccaggcggttactgcccgctcatgtgcaagagagtgtcacattcagagacgtggcagtcttcttctcacaagatgagtggctgcacttggacagcgcacagagggctctgtaccgtgaagtcatgctggaaaattattccattttggtctcgttaggtatcctgttctccaagcccaaagttataagtcaactggagcagggagaagatccgtggatggtggagtctggggtcccacagggagctcacttaggctgggagtcactgttcggcacaattgtgtcaaaggaggaaaaccaggaggtgatgaagaaattgatcatcgacgggacctttgactttaaactggaaaagacctatatcaacgaggacaaattggagaagcagcagggaaaaaaatag

SEQ ID NO: 25939 - DNA, 1713 bp, Artificial Sequence
  Description of Artificial Sequence: Synthetic coding sequence
atgcccggtgaaacagaagagcctcgacctccagaacagcaggaccaagagggaggagaagccgcaaaggcagccccagaggaacctcagcagaggccgcctgaggcagtagctgccgctccagccggtacaacctcatctcgggttttgcgcggaggaagagatcggggacgcgctgccgctgcagccgcagccgctgccgtcagccggcgacggaaggccgaatacccccgtaggcggagaagctccccaagcgctagaccaccagatgtacccggtcagcagccacaagctgcgaagagcccaagtcctgttcaggggaaaaagagcccacgactcttatgtattgagaaggttacgaccgataaagacccaaaggaggaaaaagaagaagaagacgacagcgctttgccacaggaggtctccattgctgctagccgaccttcacgtgggtggcggtcttcaaggacatctgtgtcaaggcatcgggataccgagaacacgcgctcatcacggtccaaaaccggaagcctccagctcatctgtaaaagcgaacctaatacagatcagctggactacgacgtgggagaggaacatcaaagtcccggtggaattagctccgaggaagaggaagaggaagaggaagaaatgctgatctctgaagaagaaattccctttaaagacgatcctcgtgacgaaacttacaagccccatctggaacgcgagaccccaaaacctaggcgcaagtctgggaaggtgaaggaagagaaagaaaagaaggaaatcaaagtggaggtggaagtagaggttaaagaggaggagaatgagatccgtgaagacgaagaaccccctcgtaagagagggagacggaggaaggacgacaagtctcccagactgcctaaacgacgcaagaagccgcctatccagtacgtccgttgtgaaatggagggctgcggcaccgtgctagcccatccacgttatcttcagcatcatatcaaataccagcatttgttgaaaaagaagtacgtgtgtccccacccctcatgcggtcgtctgtttaggctgcaaaagcagttactgcgacatgctaaacaccatacagatcagagagattacatatgtgaatattgcgcacgcgctttcaaatcatcccataacctggcagtacataggatgatccacaccggtgagaagcccctgcaatgcgagatatgtgggtttacgtgtcggcaaaaagcctccctgaactggcatatgaagaagcacgacgccgattccttttatcagttcagttgcaacatttgtggtaagaagttcgaaaaaaaagatagtgtagtcgctcacaaggctaaatcccatcctgaagtcctgatcgcagaggcattagcagccaatgccggagccctaataacatctactgatatcctgggcaccaaccctgagtcattgactcagccgtccgacggacaagggctccccctgttaccagagccccttgggaattcgacctctggcgaatgtctcctcctcgaagccgagggcatgtcgaagtcgtattgttccggaaccgaacgggtgtccctgatggctgatggcaaaatctttgtggggtccgggagcagcggaggcactgaagggcttgtaatgaattctgatatactgggagcaactaccgaagtgctcattgaggactccgattccgccggtccttag

SEQ ID NO: 25940 - DNA, 1590 bp, Artificial Sequence
  Description of Artificial Sequence: Synthetic coding sequence
atgcctggcgagacggaagagcccaggcccccagaacagcaggatcaagagggaggggaagctgcaaaggcagctcctgaagagcctcaacagagaccccctgaagctgtggctgccgcaccagcaggcacaacaagtagtcgagttttgcgcggtggacgtgatcggggacgtgcagcggctgctgctgctgccgcagcagtgtctcgccgacgaaaggcagagtacccacgacgccgaagaagctccccctctgccagaccccctgacgtgccaggccagcagccgcaggcagcaaaaagtccctcccctgtgcagggtaaaaagagtccccgactgctgtgtatcgagaaggttactactgacaaggatcccaaagaggagaaagaggaagaggacgatagcgccctgccccaggaagtgagtatcgccgcttcaagaccgtcgagaggctggaggagcagtagaacttctgtctctaggcatcgagataccgagaacacccgctcgagccgttcaaagacgggaagcctacagctgatctgcaaaagcgaacccaatacagatcagcttgactacgacgtgggagaggagcatcagagccctgggggaattagctctgaagaggaagaggaggaggaggaggagatgctgatctccgaggaagagattcctttcaaggacgatcccagggatgaaacctacaaaccgcacctggagcgcgagacgcctaagcctcgcaggaaatccggcaaagtgaaagaagagaaggagaagaaagagatcaaggtagaggtagaggtcgaggttaaggaagaggaaaatgaaatcagagaagatgaggagcctccacgcaagcgtggcaggagaaggaaggatgataaatcccccagactgccaaaacggagaaagaaacccccaattcagtacgtgagatgcgaaatggagggctgcggaaccgtgttagctcacccccgatatctacagcatcacataaaataccagcacctgttgaaaaaaaagtatgtgtgccctcatcctagctgcggaagattgttcaggctacagaagcagttactgcgccacgccaagcaccataccgaccaaagagactatatttgtgagtactgtgctcgggctttcaaaagcagccacaacttggcggtgcaccgaatgatccacactggcgaaaagcctcttcagtgcgaaatctgcggcttcacatgtagacagaaagcctcactgaactggcatatgaaaaaacacgatgctgacagcttctaccagttctcatgcaacatctgcggaaaaaagttcgagaagaaagactctgtggtcgcccacaaagctaaaagtcatccagaagttttgatcgcggaagccctcgccgcaaatgccggtgcactgattactagcaccgatattctggggactaatccagagtcacttactcaacccagtgatggccagggcttgcctcttctccctgaaccgctcggcaactccacgagtggggagtgcctccttcttgaggcagaagggatgtctaagagctactgtagcggaactgaacgagcaagacacagatag

SEQ ID NO: 25941 - DNA, 1464 bp, Artificial Sequence
  Description of Artificial Sequence: Synthetic coding sequence
atggctgctgctgctctacgggcacctacacaggtgaccgtttctcctgagacccacatggacctcacaaaaggctgtgttaccttcgaagacattgccatctatttttcacaggacgaatggggcctgctcgacgaagctcagcgcctcctctatctggaggtaatgctggagaactttgccctggtcgcctctctcgggtgcggccacggcaccgaggacgaggagaccccatctgatcagaacgtgtctgtcggcgtctcccaatccaaagcagggagctcaacacaaaaaacgcagtcttgcgagatgtgtgtgccagtgctgaaggacattctccacctggcagacttgccaggtcagaagccatacctcgttggtgagtgtaccaatcatcatcagcatcagaaacaccactcagctaagaagtcattgaagcgcgacatggaccgggctagctacgtgaaatgctgtctcttttgtatgtccttgaagccttttagaaaatgggaggtcggaaaggacctaccggcaatgctgaggctcttaaggtcccttgtcttccctggcggaaagaaacccggaacaatcactgagtgcggagaagacattagatcacagaagtcccattacaagtcaggtgagtgtggtaaggcatctcgccacaagcataccccggtatatcatccccgtgtgtacactggcaaaaagctttacgaatgcagcaaatgtggcaaggcctttaggggtaagtattcattagtccagcatcagcgtgtccacacaggcgaaagaccttgggaatgcaatgagtgtggaaagttcttctcacagacgtcacaccttaatgaccaccgcagaatacacaccggcgagcggccatacgagtgctctgaatgcggaaagctgtttcgacagaatagctctcttgtggatcaccagaagatccacaccggtgcacggccatatgaatgttctcagtgtggaaaatctttctcccaaaaggctaccctcgtcaagcatcaacgcgtccacactggagagagaccctataagtgcggtgaatgcggcaatagtttttctcagagcgctatactgaaccagcaccgtaggatccacaccggggctaaaccttatgaatgtggacagtgcgggaagagcttctcacaaaaggcaacactgataaagcaccagagagtccacaccggcgagcgcccatacaaatgcggtgactgtgggaagtccttttcgcagtccagtatccttatccagcacagacggatccataccggcgcacgtccttatgaatgcggacaatgtggcaagtctttcagccagaagagcgggctcatccaacatcaggtggtgcacaccggggagcgaccttacgaatgcaataaatgcggcaactccttctcccagtgtagttctctaatacaccatcaaaagtgccataacacctag

SEQ ID NO: 25942 - DNA, 1317 bp, Artificial Sequence
  Description of Artificial Sequence: Synthetic coding sequence
atggacttaacaaagggctgcgtgacattcgaggatatcgccatctacttttcacaggatgaatggggactgctggacgaagcccaacgtctgttatatttggaggtcatgctcgagaactttgcactggtcgcctctctcggctgcggtcacggtaccgaagatgaagaaacccccagcgatcagaatgtttcagtcggtgtcagccagagcaaagccggatcgtctacacaaaagacgcagagctgtgagatgtgtgtgccagtattgaaggacatccttcacctcgccgatttgccgggacaaaagccttacctcgtcggggaatgcactaatcaccatcagcaccaaaaacaccacagcgccaaaaagtcacttaagagagatatggacagagcatcttacgttaagtgctgcctgttctgtatgtccctcaagccattcagaaagtgggaagtcggcaaagatctcccagccatgttaagattgttaaggtcactcgtgttccctggcggaaaaaagcccggtacaattactgagtgcggggaagatatcagaagtcagaaatcccactacaaaagcggtgaatgtgggaaagccagccgccacaagcacaccccggtttaccatcccagggtttatacggggaaaaagctgtatgagtgttctaaatgtggaaaggctttccgtggaaagtattctcttgtgcagcatcagcgagtccataccggggagaggccatgggaatgcaatgagtgcggaaaatttttttcccagaccagtcacttaaatgaccaccgccgtattcacacaggggaacgcccatatgagtgttcacagtgcggcaagagcttctcacaaaaggccaccctggttaaacatcagagggtgcatactggggaacggccttataagtgcggcgaatgtgggaactcctttagccagtccgctatcttgaatcagcacaggagaattcacacaggcgcaaagccctacgaatgtggccagtgtggaaaaagcttttcacagaaagcaactctcatcaaacaccagcgggtacacaccggcgagaggccatataagtgtggcgactgtggtaaaagtttctcccaatccagcattctgatccaacacagacggatacatacaggagccaggccttacgagtgcggacagtgcggaaagtccttctcacaaaaatctggcttgatccagcaccaggtcgtgcacacgggagaacgcccttacgagtgtaataagtgcggtaattcattctcgcagtgctcgagtttgattcatcaccagaagtgccactag

SEQ ID NO: 25943 - DNA, 1425 bp, Artificial Sequence
  Description of Artificial Sequence: Synthetic coding sequence
atggctgccgctgccttgcgggctccaactcagggctgtgtgacttttgaagacattgccatctattttagccaggatgaatggggtctgttggatgaggcccagcgattattgtacctggaggtgatgctcgaaaattttgccctcgtcgctagcctgggatgcggacatggtactgaggatgaggaaactcctagtgaccagaacgtgtctgttggtgtaagccagtccaaagctggaagctcaacccagaaaacccaatcttgcgagatgtgtgtgcctgtgttaaaggacatactccaccttgccgacctgccagggcagaaaccctacttggtgggggaatgcacaaaccaccaccagcatcagaaacaccacagtgcgaaaaagtcactcaagcgggatatggatcgcgcaagctacgtgaagtgctgtttattttgcatgtccctgaagccatttcggaaatgggaagtcggtaaggacttacctgccatgttgcgtctgctccgaagtcttgtgtttcccggagggaagaagccaggcaccatcaccgagtgcggagaggacatccgaagccagaaatctcattataagagcggggaatgcggtaaggcctccagacataagcacacccccgtctaccaccctagagtgtatacaggtaagaagctgtacgagtgcagcaaatgtggtaaggccttcagaggaaagtacagcctggtccaacaccagagagtccacactggggagagaccgtgggagtgtaatgagtgcgggaagtttttcagtcagacttcccatctcaacgaccaccggcgtatccacactggcgagaggccctacgaatgctccgagtgcggaaagctgttcagacaaaattcttcattggtggatcatcagaagatccacacgggggctcgcccatacgaatgcagtcagtgcggcaagtcattctcgcagaaggcaacactggttaaacatcaaagggtgcatactggggaacgcccttacaagtgcggcgagtgcggtaactcctttagccaaagcgcaattctgaaccagcacaggaggattcacactggtgctaagccttacgagtgtggacaatgcggtaaatcgttttcacagaaggcgactctgatcaagcaccagcgcgtgcacaccggcgagagaccttataaatgcggcgactgcggaaagagcttttcccagagctctattcttatccaacacagaagaatccacacaggtgcaaggccatacgagtgcgggcagtgtggaaaaagtttcagtcaaaagtcgggactcatccagcaccaggtggtccacacaggcgagcggccatacgaatgtaataaatgcggcaactcattctctcagtgtagcagcttgattcatcaccaaaaatgtcacaacacatag

SEQ ID NO: 25944 - DNA, 1464 bp, Artificial Sequence
  Description of Artificial Sequence: Synthetic coding sequence
atggcggctgctgcacttagagcccctactcaggtcaccgttagtcccgagactcacatggacttaacgaagggttgcgtcaccttcgaggacatagccatctatttctcccaggacgagtggggattgctcgatgaggctcagcgattgctctacctggaggtgatgctagaaaatttcgctctggtggcctctctcggctgcgggcacggcactgaggacgaggagactccttctgatcagaatgttagcgtcggggtctcccaaagtaaggccggaagcagcacacagaagactcagagctgtgaaatgtgcgtcccagttctgaaagatatcttacacttggctgatctcccaggccaaaaaccttacctggtgggagaatgtacaaaccaccaccaacatcaaaagcatcactcggccaaaaagagccttaaacgcgatatggacagagcctcctacgtgaaatgttgtctgttttgtatgtcattgaaacccttcagaaaatgggaggtgggaaaagatttacctgcaatgctgcgactgctccgaagtctcgtcttcccaggaggaaaaaagccaggcactatcaccgagtgcggggaagacattcgaagccaaaaaagtcactacaagtccggcgagtgcggcaaagccagccgccataagcatactccagtgtaccatccgagagtctacacgggaaagaaactatatgagtgtagtaagtgcggcaaagcctttagagggaaatacagtttagtgcagcatcagagggttcacacaggggaacggccatgggagtgcaatgaatgcggcaagttctttagtcagacatcacatcttaacgaccaccggcgaatccataccggcgagcggccttacgaatgctcagagtgcggtaagttattccggcagaactcatctctggtggaccatcagaaaattcacaccggagcgaggccgtatgagtgtagccagtgcggaaaatctttcagccagaaggctacactcgtcaaacatcagagagtgcacaccggagagcgcccatataagtgcggcgagtgcggaaattcattttctcagtccgcgatactgaaccagcacagaaggatccacaccggcgcaaagccttatgaatgtggtcaatgtggcaagtcctttagtcagaaggcgaccctcattaagcaccaacgggtgcacaccggcgagcggccttacaagtgcggagactgcggtaaaagtttctcgcaaagttctatcctgattcagcatcgcagaatccacactggtgctcgtccttatgaatgcgggcagtgcgggaagtcgttctcacagaagagtgggctgattcagcaccaagtcgtccacacgggagaacgaccatacgagtgcaacaaatgtggcaacagcttttcccagtgttccagcctcatacatcatcagaagtgtcacaacacttag

SEQ ID NO: 25945 - DNA, 1692 bp, Artificial Sequence
  Description of Artificial Sequence: Synthetic coding sequence
atgatgacagcagagtctcgagaagccaccggactctcccctcaagctgcccaggaaaaagacggcatagtgatcgtgaaggtcgaagaggaggatgaggaggatcacatgtggggccaggattcaactctgcaggatacaccgccaccagacccagaaattttcagacagcggttccgcaggttctgttatcagaacaccttcggccctcgagaggcgcttagccgactgaaggagctgtgccatcagtggctacgcccagagatcaatacaaaggaacaaattttggagctattggtgcttgagcagttcctttccatattgcccaaagaactgcaggtgtggcttcaggaatacagacccgactcaggagaggaggccgtgaccctgctagaagacttagaactcgacctgagcgggcagcaggtacccggacaggtgcatgggccagaaatgcttgcccgtggtatggttcctctcgaccctgttcaggaatcttcttctttcgatctccaccacgaggcaactcagtcacacttcaaacattcctctaggaaaccgcgactgcttcagtctagagccctgcctgccgctcacatccccgcacctccacatgaggggagccccagggatcaagcaatggcctctgccctgttcaccgccgactcacaagccatggtcaagatagaggatatggccgtctcacttattcttgaagagtggggttgccagaacctagccaggcggaacctgtccagagacaatcgccaagaaaattacgggtctgccttcccacaggggggagaaaaccgcaatgaaaatgaagagtctacatccaaagccgaaacatcagaggatagcgcatctagaggagaaaccacagggagatcgcagaaagagttcggagagaaacgcgaccaagaaggaaagacgggcgagcgccagcagaagaaccctgaggaaaagacaaggaaagaaaaacgggattctgggccagcgattggcaaggacaagaagaccattacaggcgaacggggacccagggagaagggaaagggcttaggcagatctttctcactctcatcgaactttactactcctgaggaagtccctaccggcacgaagtcccacagatgcgacgaatgtgggaagtgcttcactcgttccagctctctgattagacataagataatccacacaggggaaaagccgtacgagtgcagcgaatgtggaaaggcattctctctcaattcaaacctggtgctccatcagaggattcacacaggcgagaaaccacatgagtgcaacgaatgtggaaaggcattctctcattcgtcaaatctgattctccaccagcggattcactcaggcgagaaaccatacgagtgtaacgaatgtggaaaagcttttagtcaaagctctgatctgaccaaacaccagcggattcacacaggggagaaaccctatgagtgcagtgagtgcggcaaggccttcaatagaaacagctatctaatattacaccgtcggatccatacacgtgagaaaccttacaaatgtactaagtgtggaaaggcatttacgaggtcttcaactctgaccctgcatcaccgaatacacgccagggagcgcgcaagcgaatactcgcctgcgagcctggatgcattcggggcttttctgaaatcctgtgtctag

SEQ ID NO: 25946 - DNA, 1584 bp, Artificial Sequence
  Description of Artificial Sequence: Synthetic coding sequence
atgtgggggcaggactccactctgcaggacacaccccctccagatccagagattttcagacagaggtttcgcagattctgctaccaaaacacatttggtccccgagaagccttgagcagactcaaggaactttgccatcagtggctcagacccgagatcaacaccaaagagcagattctcgagcttctggtgctggaacaatttctgtccatcctgcctaaagaactgcaggtttggctgcaggaatacagacctgatagcggggaagaagccgtcactttactcgaggacctggaactcgatttgtcaggacaacaggttcctggacaggttcacggtcctgaaatgcttgctcggggaatggtgccacttgaccctgttcaggagtcttccagcttcgatttgcatcacgaagccactcagtcccactttaagcactcatcacggaagccacgactgcttcagagtagagcattgcccgctgcccacataccagcaccccctcacgagggatcccctcgtgatcaggcaatggcctctgctctctttactgcagattcccaggccatggtgaagattgaagatatggccgttagcttgatcctggaggagtgggggtgccagaacttagccagacgaaatctcagtcgggataaccggcaagagaactatggcagtgcctttcctcaagggggtgaaaatagaaacgagaacgaggagtctacctcgaaagccgagacttcggaggacagcgccagccgcggtgagaccacgggacgaagccaaaaagagttcggcgaaaagcgggatcaagaaggaaaaaccggcgagagacagcaaaagaaccctgaagaaaaaacccgcaaggaaaagagggattctggccctgccattgggaaagataaaaaaaccatcacgggcgaacgaggcccaagggagaagggtaaaggactcggacggagtttcagcttgtcttcgaactttaccacacctgaagaggtgcctaccggtacgaaatctcataggtgcgatgagtgcggcaaatgttttactaggtccagctcacttatacggcacaagatcattcataccggagagaagccatatgaatgttctgagtgcgggaaggctttttccttgaactcaaatctggttttgcaccagcggatccatactggtgaaaagcctcacgagtgtaacgagtgtggaaaagccttcagtcactccagtaatctgatattgcaccagagaatccattcaggggaaaagccctacgagtgcaatgagtgcggcaaagctttctcgcagtcgtctgacttgaccaaacaccaaagaatccacactggggaaaagccttacgagtgttctgagtgcggcaaggctttcaatcgaaactcttatttgatcctgcacaggcgcatccacacacgtgagaagccttataagtgtactaaatgtggtaaagcttttacccgcagctctacgctcacgttgcaccaccgaatccacgcacgcgaacgggcaagtgagtacagccccgcttccctcgatgcctttggtgccttcttaaagtcttgcgtgtag

SEQ ID NO: 25947 - DNA, 378 bp, Artificial Sequence
  Description of Artificial Sequence: Synthetic coding sequence
atgatgactgctgaaagcagggaagcaacaggccttagtcctcaagccgcacaagagaaagatgggatcgtgattgtgaaggtggaggaggaagacgaagaagatcacatgtgggggcaagactccacactgcaggacacccccccaccagatcctgaaatttttaggcaacggtttcgcaggttctgttaccagaacacctttggcccaagggaggccctgagtcggctgaaggaattgtgtcaccaatggctgcgaccagaaataaatactaaggaacagatcctggaactgttggtactggagcaatttctgtcgatcttgcccaaagaactacaagtgtggctccaggagtacaggccagattctggggagtag

SEQ ID NO: 25948 - DNA, 1053 bp, Artificial Sequence
  Description of Artificial Sequence: Synthetic coding sequence
atggcttcagccctctttactgcagattcgcaagcaatggttaagatcgaggacatggccgtgtctctgatcctggaggagtggggctgccagaatcttgcacgacgcaacctgagccgagataaccgtcaggaaaactatggctctgccttcccccaaggcggtgaaaaccggaatgagaatgaagaaagcacatcaaaagccgagacttcggaagatagcgcctctagaggtgagactaccgggcgttcacagaaggagttcggggagaaacgggatcaggaaggcaagactggggaaaggcagcagaagaaccctgaggaaaaaactcggaaggagaagcgcgacagcggccctgctatcggcaaggacaagaagacgatcacgggcgaaagagggccacgcgagaagggtaaaggcctcgggcgatccttttcgctgtcttccaacttcaccactccagaggaggtacctactggcactaagtctcatcgctgtgacgaatgcgggaagtgctttactcggtcttcctctcttatccgacataagatcatccacaccggggaaaagccatatgaatgttctgagtgtggtaaggcctttagtctgaatagcaatctggtgttgcatcaacgcattcacactggagagaaacctcacgaatgcaatgagtgcggtaaagcattttcccactccagcaacttaattctgcaccaaaggatccattctggcgagaagccatacgagtgtaatgagtgtggcaaagcctttagtcagtcctccgaccttacaaagcatcagagaatccacacaggcgagaagccatacgagtgtagcgagtgtgggaaagcttttaaccgcaacagctacctgattcttcaccgtaggattcacacccgcgaaaaaccatacaagtgcactaagtgcggtaaggcctttaccagatctagcacccttactcttcatcacagaattcacgcaagggagagggcatccgaatactctcccgcttctcttgatgcattcggcgcattcctgaaatcttgcgtgtag

SEQ ID NO: 25949 - DNA, 2904 bp, Artificial Sequence
  Description of Artificial Sequence: Synthetic coding sequence
atggctgtggccctggattcacagatcgatgccccactggaagtggagggatgcttgatcatgaaggtcgaaaaagatcctgaatgggccagtgaaccgattctggagggctctgattcttccgagacgttcagaaaatgtttccgccagttttgctacgaagatgtgacaggaccccacgaggcattcagcaaactctgggagttgtgctgccgttggcttaagcccgagatgaggtctaaagagcagatcctcgagcttctcgttattgagcaatttctgaccatccttcctgagaagattcaggcctgggcgcagaaacagtgtccacagtccggcgaggaagctgtcgctcttgtcgtccacctggagaaagagacagggcgtctccggcagcaggtgtcgagtcctgtacaccgggagaagcactcccctctcggagccgcttgggaggtggctgattttcagcccgagcaggtggagacacaaccccgagccgtgagtagggaggagcctggctccctacacagcggccatcaggaacagctaaaccgcaagagggaaaggaggcccctgccgaaaaatgctcggccttctccctgggttcccgcactcgcagacgaatggaatactctcgaccaggaggtgacaacaacccggctgcctgcagggtcacaggagccagtcaaagacgttcacgtggccagggggttttcctatcgcaaaagcgtgcaccaaattccagcccagcgcgatttatacagggatttccgcaaagagaatgttggcaatgtagtgtctttgggcagcgctgtgtccaccagtaataagataacccgtctagagcagcgtaaggagccatggaccctcggcctgcactcgagcaacaagaggtccatcttgcggtcaaattatgtgaaggaaaaatccgtgcacgcgatccaggtgccagcgaggtccgccggaaaaacctggagagaacagcaacagtggggcctagaggatgaaaagattgccggagtacactggtcttacgaagagacaaagaccttccttgctattctcaaggagtccaggttttacgaaacgctccaggcttgcccccgtaacagtcaggtatatggtgcggtagctgagtggctccgcgaatgcggttttctcagaacgcctgagcagtgtcgcaccaaattcaagagcctacaaaagtcttatagaaaagtgagaaatggtcatatgctcgagccatgtgccttcttcgaggatatggacgcactcctgaaccccgctgcacgtgccccatccaccgacaagcccaaggagatgatcccagtccctaggctaaaacggatcgccattagtgctaaggagcacatatcactggttgaggaagaggaagccgcagaggactccgacgatgacgagatcggaatcgagttcatccgcaagtccgaaatacatggagcacccgtgttatttcagaacctatctggcgtgcactggggatatgaggagacaaaaaccttcctcgatatcctacgtgagacaaggttttacgaggctctccaggcctgtcatcgcaaatctaagctgtacggagccgtcgcagaacaacttcgggagtgcggatttctaaggactccagaacagtgccgcaccaagttcaaatcgctgcagaaaagctacagaaaggtcaaaaacgggcatgtcctggaatcttgtgctttttataaagagatggatgccttgatcaattcccgcgcatcagccccttccccatcaacacccgaggaggtgccctcaccgtcccggcaggagcggggtggcatcgaagtggaaccccaggaaccgacaggatgggagcctgaagaaacgagccaggaagcagtgattgaggattcatgttccgagaggatgtccgaggaagaaatagtgcaagaacccgaattccaggggccacctggactcctgcagagtcccaacgactttgaaatcggaagtagcatcaaagaagaccccacacagatcgtctacaaagatatggaacagcaccgcgcactcatcgagaagtctaagcgggtggtgtcacagtcaaccgatccatccaagtaccgcaaaagagaatgcataagtggtcgccaatgggaaaatctccagggcataagacaaggtaagcctatgagccagcctagagacctgggaaaagccgtagtccaccagcggcctttcgtcggaaagcgtccctaccgactcctgaaatatggagaaagctttggcagatctacacgactcatgtgcagaatgactcatcataaggagaacccatataaatgtggggtatgcggcaagtgctttggacgaagccggtcattaattcgccaccagcggatacataccggggaaaaaccatttaagtgtctcgactgtgggaaatctttcaatgactcgagcaactttggagcccaccaacgaattcatacaggtgaaaaaccttatcgctgtggcgagtgtgggaagtgtttcagccaatcaagcagtctgatcattcatcaaaggacccataccggagaaaagccgtaccaatgtggtgaatgcggaaagtcttttaccaacagtagccacttttcggcacatcgccgagtgcacactggtgagaacccttataaatgtgtggactgcgaaaaatcttttaacaattgcacccggtttagggagcacaggaggattcataccggagagaagccctatggatgtgctcagtgtggaaaacgtttcagtaaatccagcgtgttgaccaagcatcgcgaagtgcacgtaagggagaagcctttaccgcaccccccttctttatactgccccgagaatcctcataagggcaaaaccgacgagtttcggaaaaccttttag

SEQ ID NO: 25950 - DNA, 2511 bp, Artificial Sequence
  Description of Artificial Sequence: Synthetic coding sequence
atggcggttgccctagatagccaaattgatgctccattagaggtggagggctgcctgatcatgaaggtggagaaagatcccgagtgggcttccgagccaatcctggaagggagcgacagtagtgaaactttccgcaagtgcttccggcagttctgttacgaagatgttaccgggcctcatgaggcgttcagtaagttgtgggaattgtgttgtcggtggctcaagccggagatgcggtcaaaggagcagattctggagctgctggtgatagaacaattcctgactatcctgcctgagaaaatccaggcgtgggcccagaaacagtgcccccaatctggagaagaagcagtggccctcgtggtacatctcgaaaaggaaaccgggcgactaaggcagcaggtatcctcacctgtacacagagaaaagcattcgcccctgggggctgcttgggaagtggcggatttccagcccgaacaggtcgaaacccagccgcgtgcggtctctagggaggaaccaggaagtttacactccgggcatcaagaacagctgaatcgaaagcgcgaaagacgccctctgccaaagaatgcaagacccagcccgtgggtcccagctctggccgacgagtggaacacgctggaccaggaggtgacgacaacccgccttcctgcaggttcacaggaacctgttaaggatgtgcacgtggccagaggcttctcatatcggaagagcgtccatcagattcctgcccagcgcgatctctatcgtgatttcagaaaggagaacgtgggcaacgtggtgagtctcggttcagcggtgtcaaccagcaacaagatcacgcgcctggagcaaagaaaagaaccttggactctggggctgcatagctctaacaaaaggtcaattctgaggtcaaattacgtgaaggagaagagcgtacacgcaatccaagtgcccgctcgttccgccggtaagacgtggagggagcagcagcaatggggcttggaggatgaaaagatcgctggggtgcactggtcttacgaggaaaccaagacctttctagccatcttaaaggaatcacgcttttatgagaccttgcaggcgtgtccacgaaatagccaagtgtacggggctgttgcagaatggctgcgcgagtgcggtttcttaaggacccccgagcagtgccgtacgaaattcaagtcgctgcagaagtcatacaggaaggtaagaaacggccatatgctcgaaccctgtgctttcttcgaggatatggacgcactgttgaacccagccgcaagggcccctagcacagataagcccaaggaaatgatcccagttcctcgcctgaagagaatagccatctctgctaaagagcacatttcccttgtcgaagaagaggaggctgctgaggatagcgatgacgatgagatcgggatcgagttcatcagaaagagtgagatccacggggcacctgttctgttccagaacctgagcggtgtgcattggggctatgaggaaactaagacattcctcgatattcttcgggagacaagattctacgaggctctgcaagcttgtcacaggaagagcaagctctatggagcagtggccgaacagctccgggagtgcgggtttctccgcactccagaacagtgccgcaccaaattcaagtccctccagaaaagctaccggaaagtaaagaatggccacgtgctagaaagctgtgctttctacaaagaaatggatgccttgattaatagtagggctagcgcgccttccccttccactccagaagaggtgccaagtccatcccgccaggaacggggaggaattgaggtagagccccaagagccaaccggatgggagcctgaggagacaagccaggaggcagtgatcgaagattcttgctcggaaagaatgtcagaggaggaaatcgttcaggaacctgaattccagggtcccccaggtctgttgcagagccctaacgattttgagataggctcttccataaaagaggacccgactcagatcgtgtacaaggatatggagcagcatagggcattaatcgagaagtctaaacgggttgtctcacagtcaaccgatcctagtaagtacaggaaaagagagtgcattagtggcaggcagtgggagaacttacaggggattcgacaggggaaacctatgagccaacctcgcgacctgggaaaggccgtggtgcatcaaaggccatttgtggggaagcggccttatcggctgctcaaatacggtgaatccttcggacggtctacaagactgatgtgtcggatgacccaccacaaggaaaatccgtataagtgtggagtttgcggaaagtgtttcggcaggtccaggtcactaatcagacaccagaggatccataccggagaaaagcccttcaagtgtctggattgtgggaagtcatttaatgactctagtaacttcggtgctcaccaacgcatccacacaggcgagaagccctcaattagcgttctgccctag

SEQ ID NO: 25951 - DNA, 2520 bp, Artificial Sequence
  Description of Artificial Sequence: Synthetic coding sequence
atgatcatgaccgagtccagggaggtgattgatctcgatccaccagcagagactagccaggagcaggaggacctgttcatcgtgaaggtggaggaagaagattgtacatggatgcaggaatacaaccctccgacattcgaaaccttttatcagcgttttaggcacttccagtatcacgaggcctctggtcctcgggaggccctcagccagctccgcgtactgtgctgtgagtggttaagaccagagttgcacacaaaagaacaaatattagagttgctcgtgctcgagcaattcctcacaatcctgccggaagaattccagccttgggtgagagaacaccacccagaaagcggagaggaggccgtcgccgtgatcgagaatattcagagggaactggaggagaggcgccagcaaattgtcgcttgtcctgatgtgctcccacgaaagatggccaccccaggcgcagtgcaggaaagctgttccccacaccctcttactgtggatacacagccagagcaggcaccccagaagccaaggctactagaagagaacgccctgccggtacttcaggtcccaagcttgccactgaaagactcgcaagaattgacagcctctctgctctctaccgggtcacagaaactagttaaaatagaagaggtggcggacgtcgccgtgtcttttatccttgaggaatggggccacctcgatcaatcccaaaagagtctgtatagagacgatcggaaggaaaattatgggtctattacaagcatgggatacgagtccagggacaatatggagctaatcgtgaagcagatttccgatgattctgagtcccactgggtggctccggagcataccgaacgcagcgtcccgcaggatcccgacttcgcggaggtctcagaccttaaggggatggtgcagcggtggcaggtgaacccaactgtgggcaaatccagacagaatccatctcaaaagagggatctggatgccatcaccgacatctcgccaaagcagtccacccatggggagagaggccaccggtgcagcgactgtggcaaattcttcctccaagcttctaatttcatccagcaccgcaggattcacacgggggaaaaaccgttcaagtgcggagaatgtggaaagtcttacaaccagcgcgtgcacctcacacagcatcaacgcgtgcacacaggggaaaagccgtacaagtgccaggtctgtggaaaagcatttagagtctcctcccaccttgtgcaacatcattcggtgcactctggagaaaggccttatggatgcaacgagtgcggaaaaaattttggcaggcacagtcacttaatcgaacatctgaaaagacattttagagaaaagagtcagcgttgctccgacaagagaagtaagaatacaaaattaagcgtgaagaaaaaaatttctgagtattctgaagcggacatggagctctcaggaaaaacgcaacgtaatgtcagccaggtacaggatttcggcgaagggtgcgaattccagggtaagctggatagaaagcagggaatcccaatgaaagaaatcctaggtcagccgtcctctaagcgcatgaactattcagaggtgccctatgtgcataaaaagtcatctacaggggagcgaccacacaagtgtaacgaatgcggtaagagcttcattcagtccgcacatctgatccaacatcaacgtatccacacaggggagaagccttttcgctgtgaggagtgtggaaagtcatataaccaaagagtgcaccttacccagcatcagcgagtgcacacaggcgaaaaaccttacacctgtccgctctgcggaaaggcattccgggttcgaagtcatttggtgcagcaccagtcggtacattccggtgaaagaccctttaaatgtaatgagtgcgggaagggatttggaaggcgtagtcacctcgccggtcatttgcggttacactctagggagaagtcacatcagtgtcgggagtgcggcgaaattttttttcaatacgtgtccctcattgaacatcaggtgctccacatgggccagaaaaacgagaagaacggtatctgtgaagaggcgtacagctggaacttaacagtaattgaagacaagaagatcgagctgcaggagcagccttaccagtgcgacatctgtggcaaggctttcggttacagctcagaccttatacagcattatcggacacatacggccgaaaaaccatatcagtgtgacatttgcagggaaaatgttgggcagtgtagccacaccaagcagcatcagaagatctactcctccaccaaaagccaccaatgccacgaatgcgggagaggctttaccctaaagtcccacctgaaccagcaccagagaatacacacaggcgagaaaccattccagtgtaaggaatgtggaatgaatttttcctggtcctgttcccttttcaagcacctgagatctcacgaacggaccgatcccataaacacactctcggtggagggctcactgctttag

SEQ ID NO: 25952 - DNA, 2520 bp, Artificial Sequence
  Description of Artificial Sequence: Synthetic coding sequence
atgattatgactgagtctagagaggttatcgacctagaccctcctgctgaaacatcccaggagcaggaagacttgtttattgttaaagtggaggaagaagactgtacctggatgcaggaatacaatcctccgacttttgagaccttctatcaacggtttagacattttcagtaccacgaggcaagtggcccaagggaggcgctctcacagctcagagtgctctgctgtgaatggctacgccctgagctgcacactaaagagcagattctggagctgctggtcctggaacaatttctgactatccttccagaagagtttcagccttgggttagggagcatcaccccgagagcggcgaagaggccgtggcagtcattgaaaatatacagagagagctggaagagagacgccagcaaatcgtggcctgtcccgacgtgctgccgaggaagatggcgactcccggagctgtgcaggaatcttgttcaccccacccgctcacggtcgacacacagccagagcaagctcctcagaagccacgcctcttggaggagaacgcccttcctgtgctgcaggtcccatccctccccctgaaagacagccaggaactcaccgccagcctcctctccacggggagtcagaagctcgtcaaaatagaagaggtggccgacgtagctgtttcatttatcctcgaggagtggggccatctagatcagtcacagaaatcgctctatagggatgataggaaggagaactatggaagcataacctccatgggatacgagtcccgcgacaatatggaactcattgtgaaacagatttccgatgactcggagtcccactgggtggcaccagaacatactgaacgttcagtcccacaggatcccgatttcgccgaagtcagcgacctcaagggtatggtccagaggtggcaagtgaaccctacagttggtaaatcacgccagaacccatctcagaaaagagatctggacgccatcaccgacatcagccccaagcagtccactcacggggaacggggtcatagatgctcagactgcggtaagttctttctgcaggcatccaattttatacagcatcgtcgaatccataccggcgagaaaccgtttaaatgcggagaatgcggtaagtcttataatcagagagtgcatctgacccaacatcagagggtgcacaccggagaaaagccatacaagtgccaagtgtgcggcaaagcatttcgcgtttcctctcatctcgtacagcatcattctgtccacagcggtgaacgtccctacggctgtaacgagtgcggcaagaatttcggccgacacagccacctgattgagcacctcaagcgccactttcgcgaaaagagccagcgctgttccgacaagcgttctaagaacaccaagctctccgtgaagaagaaaatatctgaatacagcgaagcggacatggaactttctggtaaaacacagagaaatgtgtctcaggtccaagactttggcgaagggtgcgagttccagggcaaattagacaggaagcaggggataccaatgaaggaaattctaggccaaccctcgtctaagcgcatgaattatagcgaggtaccctatgtccataaaaaatcaagcactggcgagcggccacacaaatgcaacgagtgtgggaagagcttcatacagtccgcacacctgatccagcatcagcgcatccacaccggcgagaagcccttccggtgcgaggaatgtggcaaaagctacaaccagcgcgttcacctcactcagcaccagagagttcacaccggcgagaagccttatacatgccctctctgcggcaaggccttcagggtccgatcccatctggtgcagcaccagagcgtgcactccggtgaaaggccatttaagtgcaacgagtgcggaaagggatttggcagaagatcacacctggcgggtcacctccgactccatagtcgagagaagtcccatcagtgtcgcgagtgcggggaaatctttttccagtacgtcagcctcatcgaacaccaagtcctccatatgggccagaagaatgagaagaacgggatttgcgaggaagcttactcttggaacctgacagtgattgaggataagaagattgagttgcaggaacaaccttatcagtgtgatatttgcggaaaagcattcggctattcaagcgacttgattcagcattaccggactcacacagcagaaaagccttaccagtgtgacatatgccgtgaaaacgttgggcagtgctcccataccaagcagcatcaaaagatctattcaagcactaagagtcatcagtgccacgagtgtggacggggatttaccctcaagtcgcatctaaaccagcatcagcgaattcacactggagaaaagccttttcagtgtaaggagtgtggaatgaatttctcatggtcatgctccctgttcaagcatctgcggtcccacgagaggacggacccaataaacacgctgtcagtcgaagggagcctgctttag

SEQ ID NO: 25953 - DNA, 291 bp, Artificial Sequence
  Description of Artificial Sequence: Synthetic coding sequence
tttaggcactttcagtatcacgaagcttctggtccgcgtgaagccctctctcagcttcgggtcttgtgctgcgaatggctgcgcccagagctgcacacaaaggagcagatattagaactcctggtacttgaacagtttttaacaatcctgcccgaagagttccagccctgggtgagggagcaccaccccgaatctggagaagaggctgtcgccgttattgagaacatccagagggagttggaggagcgccgacaacaggtgtctcgagcccagtggttaactctcgtctag

SEQ ID NO: 25954 - DNA, 2520 bp, Artificial Sequence
  Description of Artificial Sequence: Synthetic coding sequence
atgattatgactgaaagtagagaagtcatcgatctggatcctccggctgagacttcccaggaacaggaagacttgtttattgtcaaagttgaagaggaagactgcacatggatgcaggagtacaaccccccaacattcgaaactttttatcaaaggttccggcacttccaataccacgaggctagtggccctcgggaagctcttagccagttgcgggtgctctgctgcgaatggctaaggccagaactgcacacgaaagagcagatccttgagctgcttgtgctggagcaattcctgaccatcctacccgaagagttccagccgtgggtcagggaacatcatcccgagagtggtgaagaggccgtcgccgtgatcgagaacatccaacgggagttggaagaacgccgacaacagattgtcgcatgtccggacgtgctgccgcgaaagatggccacgcctggtgccgtacaagaaagctgttctccacaccctctgacggttgacacccagcctgagcaggcaccccaaaagccccgtctgctggaggaaaacgctctgcctgtgttacaagtcccttcactaccgctgaaggacagtcaggaattgacggctagccttcttagtactgggagccaaaagctggttaagattgaggaagtggccgacgtcgcagtgagcttcattctcgaggagtggggacacctcgaccagagccagaagagcctctacagggacgatcggaaagagaattacggcagcataacatctatggggtatgaatccagggacaacatggagttaattgtgaagcagataagcgatgacagcgaatctcattgggtcgccccagagcataccgagagatctgttcctcaggatccggacttcgctgaagtgtctgacctgaaaggcatggtccagcggtggcaggttaaccccacggttggcaaaagccgacagaacccatcacaaaaaagagacctggatgccatcacagacatcagccctaagcagtctactcacggggagcgtggccaccgctgtagcgactgcgggaagttctttctgcaggcatctaacttcatacagcacagaagaatccataccggcgagaagccctttaagtgtggagagtgcggaaaatcgtacaaccagcgggtgcatctgacccagcaccagagagtccacaccggtgaaaagccgtataagtgccaggtgtgcgggaaggcgttccgggtatcatctcatctcgtgcagcaccacagtgtacactctggggaacggccttacgggtgtaacgagtgtgggaagaattttggacgacactcccatttgatcgagcatcttaagcggcactttagagaaaagagccagcgttgttctgataaaaggtctaagaacacaaagctctccgtcaaaaaaaaaatcagcgagtattcggaggccgatatggagctaagcggtaaaacgcagcgaaatgtctcacaggtacaggattttggtgagggttgtgaattccagggtaaactggaccggaagcagggtataccaatgaaggaaatcctcgggcagccatcttccaagcgaatgaattattcagaagtaccctacgtgcacaagaagagcagcactggagagcgccctcacaaatgtaatgagtgtggcaagagtttcattcaaagcgcccacctcattcagcatcagcgaatccataccggagaaaaaccctttcgatgtgaagagtgcggtaagtcctataaccagagagtccaccttacgcaacaccaacgcgtgcatacgggagagaaaccttacacttgccccctctgtgggaaggcattcagagtccggagccatctagtgcaacaccagtccgttcatagtggtgaacgtccattcaaatgtaatgaatgtggcaaagggtttggccgtcgttctcacctggctggccacctgaggctgcactctagagaaaaaagtcatcagtgccgggagtgtggcgagatattcttccagtacgtctcccttatcgaacaccaggtcctgcatatgggacagaaaaacgagaagaacggaatttgtgaggaggcatactcatggaacctaacagtaattgaagataaaaagattgaactgcaggagcagccgtaccagtgcgatatatgcggcaaagcctttggctactcctctgacttgattcaacattacaggactcataccgccgaaaaaccataccaatgtgacatttgtagggagaacgtgggacagtgttcacacacaaagcagcatcagaagatctacagctccaccaagagccatcaatgtcatgaatgcgggaggggctttaccctaaagagccacctgaaccagcatcagagaatacacacaggagaaaaaccgttccagtgtaaggagtgtgggatgaacttctcctggtcatgttccctgtttaaacacttacggtctcatgagaggacagatcctataaataccctgtctgtggaaggttcactgctctag

SEQ ID NO: 25955 - DNA, 2301 bp, Artificial Sequence
  Description of Artificial Sequence: Synthetic coding sequence
atgattatgactgagtcacgagaggttatagacctggatcctcccgctgagacctcccaggagcaggaagaccttttcatcgtcaaggtggaggaggaggattgtacatggatgcaggagtataacccgccaacctttgagacattttatcagcgcttcaggcactttcagtaccatgaagcatctggcccacgcgaagctctttcccagctgcgcgttctgtgttgcgaatggctgcgaccagaactccacaccaaagaacagatcctggagctattagtccttgagcaattcctcacaatcctgcccgaagaatttcagccttgggtccgagagcaccaccccgagtctggtgaggaagcggttgctgtcattgagaacatccagcgtgagcttgaggagagacggcaacagatcgtggcatgtcccgacgtgctcccgcgtaagatggctaccccaggggcagtccaggagtcctgcagtcctcaccccctgactgtggacacacagcccgaacaggctccccagaagccaaggctactggaagagaatgcactgcctgttttgcaggtacccagcctgccgcttaaggactcccaggaactgaccgcgtcactactttcgactggctctcagaagctcgtcaagattgaggaggtcgcagacgtcgccgtaagttttatacttgaggaatgggggcaccttgaccagtcccagaaaagcctgtatagagatgaccgcaaggaaaactacggctctatcacttcaatgggttatgaaagccgcgataacatggagctgatcgttaaacaaatttcggatgacagcgagtcccattgggtggcacccgaacatacggagcggagtgtcccacaggaccccgactttgccgaggtctccgatctgaaagggatggtccagcgatggcaggtgaaccctaccgtcgggaaaagcaggcagaaccctagccaaaagagggacctcgatgctattaccgacatttcaccaaaacagtcaacacatggggagaggggccacaggtgctctgactgtggtaagttttttttgcaggcatccaacttcattcagcataggcgtatccataccggcgaaaagccgttcaaatgcggagagtgtggaaagtcctataaccaacgcgtgcacctcacacagcatcaaagggtccacacgggggaaaagccatacaaatgccaggtgtgcggaaaagcgttcagagtctctagtcatcttgttcaacaccattctgtccactctggcgaacgcccatacggctgtaatgaatgcggaaagaatttcggacgccacagtcatctgatagagcacctgaaaaggcactttagagagaagtcccagcggtgctctgataagaggagcaaaaataccaagctgagcgtgaagaaaaagatttctgaatattcggaggccgatatggaactgtcgggcaagacacagagaaacgtcagtcaagtgcaggatttcggagaaggttgtgaattccaagggaagttggatcggaagcaggggattcccatgaaggagatactaggccagccctccagcaaaagaatgaactattccgaagtaccatatgttcacaaaaagagcagtactggggaaaggcctcataaatgtaatgagtgtggaaagagttttatccagagcgctcacttgatccagcaccaaaggatacacactggcgagaaaccttttcgctgcgaagagtgcgggaagtcatacaatcagcgggtgcaccttacacagcatcagagagttcataccggcgaaaagccatacacatgtccattatgtggaaaggcattccgagtccggtctcacctagttcagcaccagtcggtccattccggggaaagacctttcaagtgcaacgaatgcgggaagggcttcggcaggagatcccacctcgcagggcatttacggctgcacagcagggaaaagtctcatcaatgcagagaatgcggagagatcttctttcagtacgtgagcctgatcgaacaccaggtgcttcatatgggtcaaaaaaatgagaaaaacgggatctgcgaagaggcctattcatggaacctgaccgtgattgaagataaaaagattgagctacaggagcagccctatcaatgcgacatttgtggaaaggccttcggttattccagtgacctgatccagcactacaggacccatactgctgagaagccctaccagtgcgacatctgtcgcgtggtgatatacagaatgtctttttcactgcactgtagctgggactag

SEQ ID NO: 25956 - DNA, 1446 bp, Artificial Sequence
  Description of Artificial Sequence: Synthetic coding sequence
atgaggggcctgcccaggaagagagaggcatggactcagcctcatcctctggaagccttgtatgagagccttagagtgctggagaaggacacctccgcgacttcacagtctgtgaacgggtcaccacaggccgagcaaccatcgctggaatcgacatctaaagaagcattcttctccagggtggagaccttttcctctttaaagtgggcgggaaaacctttcgagctttccccacttgtgtgcgcgaagtacggctgggttaccgtggagtgcgatatgctgaaatgttcttcatgtcaggcattcttgtgtgctagcctgcaacctgcttttgatttcgatagatataagcagaggtgcgccgagcttaagaaagctctgtgcactgcccatgaaaaattttgcttttggcccgattctccctcccctgatagattcggaatgctgccgctggacgaacccgcaatattggtgagtgagttcctggatcggttccaatccttgtgccacctcgaccttcaactcccatcactcaggccggaagatctgaagacgatgtgcctgactgaggacaagatatctctgcttctacacctccttgaggacgaactggaccataggactgacgagaggaagacaaccattaagctgggaagtgatatccaggtgcatgtgaccgcatgcattctcagtgtatgtgggtgggcctgttcttcatccttggagtccatgcagctgtcactgattacctgcagtcaatgcatgagaaaggtgggcctgtggggatttcagcagattgagagcagtatgacagatctggacgcctcctttgggttaacaagtagtccgatccctgggctagaggggaggccagagcggctacccctcgttcccgagagccccagaagaatgatgactcggtcccaagatgctactttttccccagggagcgaacaagccgagaaatcccccggacctattgtatcccgcacacggtcatgggattccagctcccctgttgatcgccctgagccagaggcagccagtcccacgacgaggacccgccctgtgacgagatctatgggaactggcgataccccaggtctagaggtgccgagctcccccctgcgcaaggccaagagagcgaggctgtgttccagcagtagctccgacacttcctcgaggtctttctttgatcccacctcgcagcaccgggattggtgtccttgggtgaacatcacactgggaaaagaatctagagaaaacggcggaacagagccggacgcttctgcccctgctgagccagggtggaaagccgttctgacaattctcctggctcataaacagtcctcacaacctgctgaaacagactcaatgagcttgagtgaaaagagtcggaaggtcttccgcatcttccgccagtgggaatctctgtgctcctgctag

SEQ ID NO: 25957 - DNA, 1509 bp, Artificial Sequence
  Description of Artificial Sequence: Synthetic coding sequence
atggccgcaccgtgtgaaggacaagcctttgccgtcggggtcgagaagaactggggagcggtagtccgatcacccgaaggcaccccccaaaaaattagacagctgatcgacgagggaattgcccctgaggaaggcggagtcgatgcaaaagataccagtgctaccagtcagagcgtgaacgggagcccacaggccgagcagccctctctggaaagtaccagtaaggaggcattttttagtcgggtggaaacgttctcaagcttgaagtgggccggaaagcctttcgagttgagcccactcgtctgtgctaagtacgggtgggtgaccgttgaatgcgacatgttgaagtgttctagctgtcaggcctttctatgcgcctccttgcaacctgctttcgactttgacaggtacaaacagaggtgcgcagagttgaagaaggcgctgtgcactgctcacgagaaattttgcttttggccagattcacccagcccagatcgctttggaatgctgcccctggatgaacccgctattctggtgtcagagtttcttgaccgattccaaagcttgtgccatttggacttgcagcttccctcactgcgccctgaggacttgaagacaatgtgcttgaccgaagacaagattagcctcctattacatttgctggaggacgagctggaccatcgcacagatgagcggaagaccacgataaagctgggctctgacattcaggtgcacgtaacagcctgtattctgtcggtgtgtggatgggcctgtagttcctcattggaaagtatgcagctgagtctcatcacctgctcacagtgtatgcgcaaagtggggctctggggatttcagcagattgagtcctccatgaccgacctagacgcttcttttggactgacttcttcgccaataccagggctggaaggcaggccagagcgtctgccattagtacccgaatcgcctcgccgaatgatgaccaggtcgcaggatgctacctttagcccgggatccgagcaggccgaaaagtctcccggacccatcgtgagtaggacccgttcatgggatagctcctcccccgtggataggcctgagcccgaggctgcttcaccaactacaaggacccggcctgtcacacgcagcatgggcacaggagacaccccagggcttgaggtgccttccagtcctctaagaaaagccaagcgcgctcggctctgcagtagtagctcatccgacacatcatccagatcattcttcgatccgaccagccaacaccgcgattggtgcccctgggtgaacattacactgggcaaggaatccagggagaacggcggtacagaacccgacgcatctgcccctgcagagccgggatggaaagctgtgttgacaattctgctcgcccataagcaaagtagccagcctgcagagacagactcaatgtccttgagtgagaaatctagaaaggtttttagaattttccgccaatgggaatccttatgtagctgctag

SEQ ID NO: 25958 - DNA, 1296 bp, Artificial Sequence
  Description of Artificial Sequence: Synthetic coding sequence
atggccgcaccctgcgaaggacaggccttcgctgtgggagtggagaagaactggggagctgtcgtaagatcccctgaaggcacacctcagaaaatcagacagctaatagacgagggcatcgctcccgaagaaggcggagtcgatgctaaggacacctcagcaacatcccaaagtgtaaacggatccccccaggccgagcagcccagcttagaatctacgtccaaggaggctttctttagcagagttgaaacattttctagccttaagtgggcaggaaaaccctttgaacttagcccactggtctgcgcaaagtacggatgggtcacagtagagtgtgatatgctgaagtgcagctcctgtcaagcatttctgtgtgcatccctgcaaccagcctttgattttgatcggtacaagcagcgctgcgcagagcttaaaaaggcactgtgcacagctcatgagaaattttgtttttggcctgacagtccttccccagaccggtttggcatgctgcctctcgacgaacctgcaattctcgttagcgagttcctagaccgtttccaatcgctgtgccatttggacctgcagcttccttccctgcgacccgaagacttaaaaacgatgtgtctgaccgaggacaagatttccttgttattgcatctgctggaggacgaactcgatcatcgtaccgacgaacgaaaaaccaccatcaagcttggttccgatattcaagtacacgtcaccgcatgcatcctcagcgtctgtggatgggcatgcagttcttcactcgagtccatgcaactgtctcttattacctgcagccagtgcatgcgcaaagtgggtttgtggggatttcagcagatcgagtcctctatgacggatctcgacgcctcctttggtcttacctccagtccaatccccggactggagggtcgcccagagaggcttcccttggtgcccgaaagcccgaggagaatgatgaccaggtcccaggatgcaactttctcccctggatcagagcaggatacgtctagtcgctccttttttgatccaaccagccaacatcgcgattggtgcccatgggtcaatatcaccctagggaaagagtctcgcgagaatggcggaacagagccagacgcatcagccccagccgagcctggctggaaagcagtgctcacaatcctgctggctcacaaacagagctctcaaccagccgagacggatagtatgtctctctcagagaagtccaggaaagttttcagaatctttcgacagtgggagtcattgtgctcatgttag

SEQ ID NO: 25959 - DNA, 1596 bp, Artificial Sequence
  Description of Artificial Sequence: Synthetic coding sequence
atggatgaggaatctctcgagagcgctctccaaacttatcgcgctcagctacagcaggtagagctggccctgggtgccggtctggacagctcagagcaggccgacctccggcagctccagggtgatctgaaggagctgatcgagctcacggaggcaagcctagtgtctgttaggaagagctctttgctggcggcattggatgaggagagaccaggtcgacaggaggacgcagagtatcaggccttccgcgaggccatcactgaggcggtggaggctcctgctgccgctcgaggctctgggtcggagacagtgccgaaagcagaggcaggcccagagagtgccgctgggggtcaagaggaggaagagggggaggatgaggaggagctatcaggcacgaaggtgagcgcgccatactattcatcatggggcaccctggagtatcacaatgccatggtcgtcggtacagaggaagcagaagacggctccgctggtgttagagtgctctacctgtatccaacacacaagagtctcaaaccatgtccgttttttctagaggggaagtgtagattcaaggagaactgcagattctcccacggccaggtggtgtctctcgatgagcttagacctttccaggatcctgatctgagcagcctacaagctggaagcgcttgtctggcaaagcatcaagacgggctctggcatgctgcacgcataactgacgtggataatggttactatactgtcaaatttgattcactccttctacgtgaggcagtggtggaaggggatggcattttgcccccactgcgcaccgaggcaacagaatccgacagcgactcagatgggaccggagacagcagctacgctcgcgtcgtcggaagcgatgcggtggacagcgctcaatcaagtgcattatgtccaagcctagcggttgtagggagcgacgcagtggactctggcacatgttcctcagcattcgctggatgggaagtacatactaggggcatcggcagtcggctattgacaaaaatgggatacgagttcggaaagggcctgggccgtcacgccgaaggccgagtggagcccatccacgcagttgtactgcctaggggaaagtccctggatcaatgcgtcgagacactccagaagcagactagggttggcaaagccggaaccaataaacctccacggtgcaggggaagaggcgctcggcctgggggaagacctgcccctcggaatgtcttcgattttttaaacgaaaagctgcagggacaggcccctggtgcgctcgaggcaggcgcagccccagccggaagacgatccaaggacatgtaccatgcatcaaaatccgcgaagagagcgttgtcgctccgtctgttccagactgaagagaagattgaaagaactcagagagacatcaggagcatacaggaggctctggctcggaacgctggtcgccactcggtggcctcagcacagctgcaggaaaaactcgccggtgcgcagcgtcaactgggccagctccgcgctcaggaagccggactccagcaggaacaacgcaaggctgatacccacaagaaaatgacagagttctag

SEQ ID NO: 25960 - DNA, 1536 bp, Artificial Sequence
  Description of Artificial Sequence: Synthetic coding sequence
atggacgaagaatctttagaatctgcattacagacgtatcgtgcccaattgcaacaagtggaattagccctcggcgcaggactggatagctctgagcaggccgatctacgccaattacagggagaccttaaggagctgattgagctgaccgaggcatccctcgtgtccgtcaggaaatcctctctcctcgccgcacttgacgaagaaagacccggacgacaggaggacgccgaataccaggctttcagggaagcaattactgaggcagtagaagctcctgccgcagcacggggatcgggctcagaaactgttcccaaggccgaggccggacccgaaagcgctgcaggaggacaggaggaggaggaaggcgaagatgaggaagaactatccgggacgaaggtgagcgcaccatattattcgagctggggtaccctggaatatcacaacgccatggttgtaggcaccgaagaggccgaagatggcagcgcgggagttcgcgtgctgtatctgtatcccactcacaagagcctgaaaccatgtcccttctttctggaagggaagtgcagattcaaagagaattgtcgtttctcccatggtcaggtcgtgagtctggacgagctgcggccattccaagaccctgacttgtccagcctacaggcgggttccgcttgtctggccaagcaccaggacggcctctggcacgcagcaagaattacggatgtcgacaatggctactatactgtgaaattcgacagtctgctgctgagagaagcggttgtggagggagacggcatcctgcctcctctgagaaccgaggccaccgagtcagatagcgactccgacggaaccggggacagcagttacgcaagagtcgtcggctctgatgccgtggatagcggcacttgctcctcggcatttgccggttgggaggtgcatacacgaggcatcggcagccggctgctgaccaagatgggctatgaattcggaaagggtcttggtagacacgccgaaggccgagttgaacctattcatgcagtcgtcttgcccagaggaaagtcactcgatcagtgtgtcgagactctgcagaaacaaactcgtgtcgggaaggcaggcacaaataaaccgccaaggtgcagaggcaggggcgctcgaccaggtgggagaccagccccacgcaatgtcttcgacttcctgaatgaaaagcttcagggccaggccccaggtgcactagaagccggtgccgcacccgcaggcaggaggtccaaagatatgtaccacgccagtaaaagcgctaagagagcactatctctaaggctgttccagaccgaagagaaaattgagagaacccagcgtgatattagatctatccaggaggcgctggctaggaacgccggaagacattctgtcgcgtcggcgcaacttcaggaaaagctggctggagctcaaaggcagctgggccagcttagggctcaggaggccggtcttcaacaggaacagcgaaaagctgatacacataaaaagatgacagaattctag

SEQ ID NO: 25961 - DNA, 1509 bp, Artificial Sequence
  Description of Artificial Sequence: Synthetic coding sequence
atggatgaggaatccctggagtctgctctccaaacctaccgcgcacagctccagcaggtggagctagctctgggcgcagggcttgacagctccgaacaggccgatttaaggcagctgcagggagacctgaaggagctcattgagctgaccgaggcctctctggtgagcgtaagaaagagctcactcctggcagcacttgacgaggagcgcccaggtcgccaggaggatgcagagtatcaagccttcagagaggccatcactgaagcagtcgaggcgcctgctgctgcgagaggaagcggctccgagacagtgcctaaggccgaagctgggcctgagtccgctgccggaggccaggaggaggaggagggtgaggatgaggaggaactatctggaaccaaggtctccgccccatattattcatcctgggggactctagaataccataatgctatggtggttggtactgaggaggctgaagacggcagcgcgggagttcgagtgctttacctgtaccccactcataaatcactgaagccctgccccttctttctggagggcaaatgtagattcaaagagaactgcagattttcccacgggcaggtcgtgagcctggatgagttacgaccctttcaggatcctgatctgtccagcttacaagccggaagtgcctgcctggcgaagcatcaggatggcttatggcacgccgcaaggattacggacgtggataacggatattacaccgtgaaattcgattcacttctgttacgtgaagccgttgtggagggcgatggcatactccctcctctgcggactgaagctacagaaagcgactccgactccgacgttgtgggctcagacgccgtggattcagggacctgttctagcgcatttgctggatgggaagtccacacccgcggtattgggagccgtctcctcacgaagatgggatacgagttcggtaagggcctgggcaggcacgcagaggggagggtcgaacctatacacgcagttgtgctccccaggggcaagagtctggatcagtgtgtagaaactcttcaaaaacaaaccagagtcggaaaggctggaacaaataaaccgcctaggtgccgcggtcgcggtgctaggcctgggggtagacctgcaccccgtaatgtatttgacttcttgaacgagaaactacaggggcaggcaccaggagcccttgaggctggggctgctcccgcaggtaggcgctccaaagatatgtatcacgcgagcaaatcggcgaaacgcgctttatctttaagactcttccagacagaggaaaaaattgagcggacccagcgagatatccgtagcatacaagaagcgctcgcgaggaacgccggtagacattcagtcgccagcgcacagcttcaggagaagctcgcgggagcccagcgccagcttgggcagctcagggcacaagaggccggactacagcaggagcaacgcaaggcagatacgcataaaaagatgaccgagttttag

SEQ ID NO: 25962 - DNA, 1536 bp, Artificial Sequence
  Description of Artificial Sequence: Synthetic coding sequence
atggacgaagagtctctggagagcgcactacagacttacagggctcagctgcaacaagtggagctggccctgggggcaggcctggattcttctgagcaagccgaccttaggcagttacagggcgatctgaaagaattgattgagctaaccgaagcctcccttgtcagcgttcggaagtccagcctactggcagcacttgatgaagaacgaccgggaaggcaggaggacgctgagtaccaggcttttcgcgaggccataacggaggcagtggaggctcctgctgcggctcgcggttccggcagcgagacagtaccaaaggctgaagccggtccagaatctgctgcaggcggacaggaagaagaggagggcgaggacgaagaggaattatccgggacaaaggtttcagccccttattattccagctggggcaccctagaatatcataacgcaatggttgttggtacagaagaggcagaagacggaagcgcaggcgtccgggttctgtacctttatcctacacataagtcactgaagccatgcccctttttcctcgaaggaaagtgtcgcttcaaagagaactgccggttctctcacggtcaggtggtatctctggatgagctccgccctttccaagacccagaccttagcagtctacaggctgggtctgcatgtctggctaaacaccaagatgggctgtggcacgctgccaggattaccgatgtggataatggatattacacagtgaagtttgatagcctcctgctgagagaagccgtggtggaaggtgacgggatccttccaccattacgaaccgaagccactgaatccgactcggactccgacggaaccggggacagctcctacgcccgagtggtcggatctgatgccgtcgattctgggacttgctccagtgcctttgccggatgggaagtgcatacccgcggaattggctctcgccttttgactaaaatggggtacgagtttggcaagggactgggacggcacgccgagggcagggtggaacccattcacgctgtcgtgcttcccagaggtaagagcctggatcaatgtgtcgagaccctgcagaagcagaccagggtgggaaaagcaggcacaaataaacctcccagatgcaggggccgaggcgctcgccctggcggaagacccgcaccacgtaacgtctttgatttcttaaatgaaaagttgcaaggacaagcccctggagcactcgaggcgggagctgctcccgcaggaaggcggtctaaggatatgtaccacgcctcgaagagtgcgaaacgcgcactgtctctgcggttgttccaaaccgaagagaagatcgagaggacccagagagacatccgttcaattcaggaagcactggcgagaaacgccggtcgccattctgtggcaagcgcccagctgcaagagaagcttgccggagcccagcggcagttggggcagcttcgcgcacaggaggccggactgcagcaggagcagcgaaaagccgacacacacaagaagatgacagaattctag

SEQ ID NO: 25963 - DNA, 294 bp, Artificial Sequence
  Description of Artificial Sequence: Synthetic coding sequence
atggacgaagagagcctagagtctgctctacagacgtacagagcccagttgcagcaagtcgagctggcactcggagcgggattggatagctctgagcaagcagatctacggcagcttcaaggtgacttgaaagagctgatcgagctcacagaagcttccttagtgtctgtacggaagagcagtctcctggccgcactcgacgaggagcgacccggacggcaggaggacgccgaatatcaggctttccgcgaggcaatcaccgaggctgtcgaggctcctgcggcagccaggtag

SEQ ID NO: 25964 - DNA, 1536 bp, Artificial Sequence
  Description of Artificial Sequence: Synthetic coding sequence
atggacgaagagtcactagagtctgccctgcagacttaccgcgcacagctacaacaagtcgaactcgcgcttggagctggcctggattcttccgagcaagccgacctgaggcagctccaaggagatcttaaggagctgatcgagttgacagaagcaagcctggtttcggtacggaagagctccctgcttgccgctctggatgaagaaagacccggacggcaagaggatgccgagtatcaagcctttcgcgaagctattactgaggccgtggaggcccctgcagctgctcgtggctccggctcggagacagtgcctaaggccgaagcgggacccgaaagcgctgctgggggacaggaggaagaagagggagaagacgaagaggagctaagcggcacaaaggtaagtgctccttactactccagctggggcaccttagagtaccataacgctatggttgtgggaacagaggaggcagaggacggctcagccggagtccgggtactgtatctttatccaacccataagtctttaaaaccttgcccctttttccttgagggtaaatgccggttcaaagagaattgccggttctcccatggtcaggtggtgtcgttggatgaactgaggccttttcaggaccccgacctctcttcattgcaggcaggcagcgcctgtctggctaagcaccaggacgggctttggcacgccgcaaggataactgacgtggataacgggtattatactgtaaaatttgattctctgctcttacgggaagccgtggtggagggtgacggaatcctgccacccttgagaactgaggccaccgaaagcgacagcgactcagacggcactggtgacagttcttacgccagagtggtcggatcagatgcggttgatagcggtacgtgctcatctgctttcgccggttgggaagtacacacacggggaatcggcagcagactccttaccaagatggggtacgagttcggaaaaggcctcgggagacacgccgagggacgtgttgagccgattcacgcagtggtgcttccccgaggtaaaagtctggaccagtgtgtggagacacttcagaagcagacgcgcgttgggaaagcagggacgaataagccccctcgctgcagaggaaggggagcccgaccgggagggagaccagctccaaggaatgtctttgacttcctgaatgagaaactccagggacaagcccctggcgcactggaagcaggcgctgctcctgccggacgcagatccaaagatatgtatcatgcgagcaagtctgctaaaagggctctttccttaaggctctttcaaactgaagaaaaaatcgagcggacgcagcgagatatcagatcaattcaggaggctcttgctcggaacgcaggacgccacagcgtcgccagcgctcagctgcaagaaaaactggccggagcacagagacagttgggccagctgcgagctcaagaagcaggcttgcaacaagagcagcgcaaggccgatactcataagaaaatgacagagttttag

SEQ ID NO: 25965 - DNA, 1419 bp, Artificial Sequence
  Description of Artificial Sequence: Synthetic coding sequence
atgaataattcccaaggccgagtcacctttgaggacgtgacggtgaactttactcaaggcgaatggcaaaggttgaaccccgaacagcgtaacctgtacagagacgtgatgctggagaattactcaaatctggtttccgtaggacaaggcgagaccaccaagcctgatgttattctccggctcgagcagggcaaagagccatggctcgaggaggaggaggtcctgggcagcggtagagccgaaaagaacggcgacattggaggccaaatttggaagccaaaagatgtcaaggagagcctcgcacgagaagttcctagcatcaacaaggagaccctcaccacgcagaagggtgtggagtgtgacgggagcaaaaaaatcctacctttgggaatcgacgatgtttcatcactccagcattacgtgcagaacaatagtcatgacgataatgggtatcgaaagctggtcgggaacaacccgagtaagttcgtgggccagcagctgaagtgtaatgcctgtagaaagctcttttcgtcaaagtctcggcttcaaagccacctgcgacggcacgcatgtcagaaaccctttgagtgccattcttgtgggcgagcattcggagagaaatggaagttagataagcatcagaagactcacgctgaagaaagaccatataagtgcgagaattgtgggaatgcatataaacaaaagtctaatctgttccagcaccagaagatgcatacaaaagaaaaaccgtaccagtgcaagacctgcggaaaagccttcagttggaaatcaagctgtataaaccacgaaaaaatacacaatgctaaaaagtcttatcagtgcaacgaatgcgagaagtcgttccgccaaaactccacccttatccagcacaagaaagtacacacaggccaaaaaccgttccagtgcaccgactgtgggaaggcttttatttacaaaagcgacctggtgaagcaccagagaatacatactggtgaaaagccatacaagtgttcgatttgtgaaaaagctttcagccagaagtcgaatgtgattgatcacgaaaagatccatacgggaaaaagagcttacgagtgtgacctatgtggcaacacctttattcaaaaaaagaacttaatccagcacaagaagattcacacgggagaaaaaccgtatgaatgcaaccgctgcggtaaggccttttttcagaagagcaacttacacagtcatcagaagacacactccggcgagagaacctaccgctgcagtgaatgtggaaagacatttatacggaaactaaacctgtccttgcataaaaagacccataccgggcagaaaccctacggttgctctgagtgcggcaaagcctttgccgataggtcttatctggtccggcatcaaaaaagaatccactccagatag

SEQ ID NO: 25966 - DNA, 1917 bp, Artificial Sequence
  Description of Artificial Sequence: Synthetic coding sequence
atggaaagttgctcagttacccgactggaatgttccggagctatcagtgcacactgcagtcttcatctaccaggaagtagcgatagccccgcatccgccagtcaaattgccggaactactgatgccatctggaacgagcaggagaaagcagaactgttcacagacaagttttgccaggtctgcggcgtgatgctgcagttcgagagccagcggattagccactacgaaggcgaaaagcacgctcagaatgtgtccttctattttcagatgcacggagaacagaacgaggtgcctggtaagaaaatgaagatgcatgtggaaaacttccaggttcataggtatgaaggtgtggataagaataaattttgcgatctctgcaatatgatgttctcgagtcctctaatagctcaatcccattacgtaggtaaggtgcatgcaaagaagctgaagcagctcatggaggagcatgatcaagcctcgccaagtggattccagcctgaaatggcattttcaatgcgaacctacgtctgtcacatttgcagcatcgcttttacatcgttagatatgttccggtcacacatgcagggctccgagcaccagatcaaggaatcgattgttattaatctggttaagaatagcagaaagacccaggactcttaccaaaacgagtgcgccgattacatcaacgtccagaaagctcgcggactcgaagcaaaaacatgctttcggaagatggaggagtcaagcctggagactaggcgttatcgtgaggtggttgactcgaggccaaggcacaggatgtttgagcagcgattaccatttgagactttccgtacttacgctgctccctataatattagccaagctatggaaaaacagctcccccattctaaaaaaacgtacgatagttttcaggatgagctggaggattacatcaaggtccagaaggctaggggactcgacccaaagacatgcttccggaaaatgcgagagaattcagtggatacacatggatatagggagatggttgactctggcccacgctcccgcatgtgcgagcagcgcttcagccacgaagcatcccagacataccagcggccatatcatatttccccggtcgagtcgcagctgccccaatggctacctacccactccaagcgcacctacgactcattccaagacgagcttgaggattacattaaagtgcaaaaggcacgcggtctagaaccaaaaacatgtttcagaaaaatcggagattcaagcgtcgaaacccacagaaatcgcgagatggtggatgttcggcctcgccatagaatgctggagcaaaagctgccgtgcgaaacgttccagacatatagcgggccatattctatctcccaggtggtggagaatcaactcccccactgcctgcccgcacacgactccaaacaacggcttgatagtatttcttactgtcaattaacacgggattgtttcccagagaagcctgtgcccctctcactgaaccagcaggagaacaacagcggatcctacagcgtagagtctgaggtgtacaagcacctgagcagcgagaacaacacagcagaccaccaggccggacacaagcagaagcaccagaagcggaaaaggcacctggaagaaggtaaggaaagacctgagaaagaacaaagcaaacataaaaggaaaaagagttacgaggatacagatcttgacaaggataagagtatccggcagagaaagcgggaggaagaccgcgtcaaagtgagctcaggcaaactgaaacatcggaaaaagaaaaaatcccacgatgttccttcagagaaggaggaacggaaacaccggaaggagaagaagaagagtgtggaggaaagaaccgaggaggagatgctttgggatgagtctatactcgggttctag

SEQ ID NO: 25967 - DNA, 1404 bp, Artificial Sequence
  Description of Artificial Sequence: Synthetic coding sequence
atgagaacctatgtctgtcatatctgttccatagcctttactagcctggacatgtttcgcagccacatgcagggatctgaacaccagatcaaggaatctatcgtgataaacctggtgaaaaacagcagaaagacccaggatagttaccagaacgagtgcgccgactatattaatgtgcagaaggcgaggggcctcgaggcaaaaacctgctttcgtaagatggaggagtccagtttagaaacgcggaggtacagagaagttgtggactctagaccaaggcatagaatgttcgagcagcggttgccctttgagacctttcggacttatgccgctccatacaacatctcccaggcaatggaaaaacaattgccacatagcaaaaaaacttatgacagcttccaggatgaacttgaggactacataaaagtccagaaggctagaggactcgacccaaaaacttgcttccgaaagatgcgcgaaaactccgtcgatactcacggctaccgggagatggtggattctggccctaggagtagaatgtgtgagcaacgcttctcccatgaagcctcgcaaacataccagcgtccctaccatatttccccagtggagtcacagcttcctcagtggttgccaacccactcaaagcgcacatatgactctttccaggatgagttggaagactatattaaggttcagaaggccagaggcctggagcccaagacatgtttcaggaagatcggggacagctccgtagagactcacagaaacagagaaatggttgatgtccgccctagacataggatgctggaacaaaagctcccctgtgaaacgtttcagacatactcaggcccttatagcatctctcaggtcgtggagaaccagttaccccactgtctgcctgctcacgactccaaacagcgcttagactctatctcctattgtcaacttacccgcgactgtttccctgaaaagcctgtcccactgagcctgaatcaacaggaaaacaactctggctcctattcggtggaatcagaggtgtacaagcacttgtcatctgagaacaatacggctgaccaccaggcaggccacaagcagaagcaccagaagcggaagcgccatctcgaggagggtaaggagagacccgagaaagaacagagcaaacataaaagaaaaaaatcatacgaggataccgatttggacaaagataagagcattcgccagagaaagcgggaagaggaccgcgtgaaagtcagtagcggaaaattgaaacaccgaaaaaaaaaaaagtctcatgacgtccccagcgaaaaggaagaacgcaagcaccgaaaagagaaaaaaaagagcgtggaagaaagaacggaagaagagatgctttgggacgagagtattctgggcttttag

SEQ ID NO: 25968 - DNA, 1917 bp, Artificial Sequence
  Description of Artificial Sequence: Synthetic coding sequence
atggagtcgtgctccgttacacggctcgagtgctccggcgcaatcagtgcccattgctccctgcacctgcccggaagtagtgatagccctgcctcagccagtcagatagcgggaaccactgatgcaatctggaatgagcaggagaaagccgagctctttacagataaattctgtcaggtgtgtggtgttatgctgcagttcgaaagccagagaatatcacactacgaaggcgaaaagcatgcgcaaaatgtgagcttctactttcagatgcacggggagcagaacgaggtaccagggaagaagatgaaaatgcacgtagaaaacttccaggttcatcggtatgaaggggtggacaagaataagttttgcgatttgtgcaacatgatgtttagttcgcccttgattgcccagtcccattatgtgggcaaggtccacgccaagaaactaaaacagctgatggaagaacatgatcaggcctctccgtcagggtttcagcctgagatggccttcagtatgcgcacatatgtttgccacatatgttcaatagccttcaccagtctcgacatgtttcgatcacatatgcagggttccgagcaccagatcaaggagagtatagtgatcaatctcgtgaagaatagccggaagactcaggacagctaccaaaacgagtgtgcggactacattaacgtgcaaaaggccagaggtctcgaggccaagacgtgttttcgcaagatggaggaatcctctctggaaactagacgctatagggaggtcgtcgatagtaggcccagacaccggatgttcgagcaacgactccccttcgaaacgtttaggacctacgcagccccatacaacatcagtcaggcaatggagaagcagttgccccattccaaaaaaacatatgacagcttccaggacgagctggaggactatatcaaagtacagaaagccaggggcctcgatcccaagacgtgctttcgcaagatgcgtgagaattcagttgatacccatgggtatagagagatggttgacagcggccctcggagccgcatgtgtgaacaacgattctctcacgaagcatcacagacatatcaaaggccctatcacattagccctgtggagtctcaactgccacaatggcttcccactcattcaaagcgcacttacgattccttccaggatgagctggaggactatataaaggtacagaaggcacgcggattggagcccaaaacctgtttcagaaaaattggtgacagctctgtcgaaacccacaggaaccgcgaaatggtggacgtaagaccacgccacaggatgcttgagcagaaactgccctgtgaaacgttccagacatactccggcccatattccatcagccaggtggtcgagaaccagcttccacactgcctgccggcacatgattctaagcagcgactggactctatatcatactgccaacttactagggattgtttcccagaaaaacccgtgcccctctcgctcaatcagcaagaaaacaactcgggaagttatagcgtggaaagcgaggtgtataaacatttgtcctctgaaaacaataccgccgaccatcaggccggacataaacagaagcaccaaaagcgtaaacgtcacctggaggaaggcaaggagaggccagagaaagagcagtccaaacataaacggaaaaagtcatacgaggataccgacctcgacaaagacaagtcaattcggcagcggaagcgggaagaggatcgcgtgaaagtgagctctggcaaattgaagcaccgcaaaaaaaagaaatcgcacgacgttccttctgaaaaggaggaacgtaaacacaggaaagagaaaaaaaaatcagtggaagagaggacagaggaggaaatgctatgggacgaaagcatcctggggttttag

SEQ ID NO: 25969 - DNA, 600 bp, Artificial Sequence
  Description of Artificial Sequence: Synthetic coding sequence
atggcctcgggttcgggcacaaaaaatctcgattttagaaggaaatgggacaaagacgaatacgagaagctggcagagaagcgactcaccgaggagcgggagaaaaaggacggtaaacctgtgcagcctgtgaaaagagaactgttaaggcacagggactacaaggttgatctggagagcaaactgggcaaaactattgtcataactaaaactaccccccagagcgagatgggcggatactattgcaacgtgtgcgattgtgtcgtaaaggattccatcaactttctcgatcatattaatgggaagaaacaccaacggaatctgggaatgagcatgagggtcgagaggagcacactggaccaggtcaagaagcggttcgaagtgaataagaagaaaatggaggaaaagcagaaagattacgactttgaggagaggatgaaagagctgagggaggaggaggaaaaagccaaggcctacaaaaaagagaaacagaaagaaaaaaaaagaagggccgaagaagatctaaccttcgaggaggatgacgagatggcggcagtgatgggttttagtgggttcggaagtaccaagaagtcttattag

SEQ ID NO: 25970 - DNA, 870 bp, Artificial Sequence
  Description of Artificial Sequence: Synthetic coding sequence
atgatcctcctgcagcacgctgtgctaccgccaccaaaacagcccagtccctccccccctatgagcgtggcaacacgatcgaccggcacgctgcagctgccgccacagaagccatttggccaagaggccagcctgcccctcgcaggagaagaggagctgtccaaagggggtgagcaggactgcgcccttgaggaactgtgcaaaccgctgtattgtaaactttgcaatgtcactctcaattccgcccaacaagctcaggcgcactaccaaggaaaaaatcacggaaagaaattgcgtaattactacgccgcaaatagctgcccacccccagccagaatgagcaatgtggttgaaccggcagctactcccgtggtacccgtccctccccagatggggagttttaagcccggaggcagggtgattttggccaccgagaatgactactgcaagctgtgcgatgcttccttctcatcccccgcagtggcacaggcccattaccaagggaagaatcatgcgaaacgcctgcggctggccgaggctcagagtaactcattcagtgagagttctgagctggggcagcggcgagctcgcaaggaagggaatgagttcaaaatgatgccaaaccggagaaacatgtacaccgtccagaacaatagcgctggcccttacttcaatccaagatccaggcaaagaatccccagggaccttgcaatgtgtgtgactcctagtgggcagttctattgcagcatgtgcaatgtgggagccggtgaagagatggaatttagacagcatctggagtcgaaacagcacaaaagtaaagtctcagaacagagatacagaaacgagatggagaatttaggatacgtgtag

SEQ ID NO: 25971 - DNA, 447 bp, Artificial Sequence
  Description of Artificial Sequence: Synthetic coding sequence
atgattttgctgcagcacgctgtgttaccccctcctaagcagccctctccaagtccaccgatgtccgtcgctaccagatctacagggactttgcagctgcccccacagaagccctttggccaggaggcaagtctgcctctagccggagaggaggagctctccaagggaggggaacaggattgcgcactcgaagaactctgcaaaccattatactgcaaattgtgcaacgtgacgctgaacagcgcccagcaggcccaggcccactaccagggtaaaaaccacggcaagaaactgcgcaactactatgctgcaaattcttgccctccacccgctagaatgtccaatgtcgtcgaacctgcggcaaccccggtcgttccagtgcctccccagatggggtcattcaaacctggtggacgtgttatcctggcaactgaaaacgactattag

SEQ ID NO: 25972 - DNA, 867 bp, Artificial Sequence
  Description of Artificial Sequence: Synthetic coding sequence
atgatacttttgcagcacgccgtgctccctccaccaaaacagcccagcccttccccgcctatgtcagttgcaacacgatctaccggaacgctgcagcttccccctcagaaaccatttggtcaggaggcctcactaccactggcaggggaagaggagcttagcaaaggaggggagcaagactgcgcactcgaggaattgtgtaagcccttgtattgtaagctctgtaacgtcaccttgaacagcgcccaacaggcacaagcccactatcagggaaagaaccacggtaagaaactcaggaattattatgctgccaactcatgtcctccccctgccagaatgagcaatgtggtggagccggcagccacgcccgttgtaccagttccccctcagatgggcagtttcaagcccggaggacgcgttatcctggcgacagaaaacgattactgtaagctgtgtgacgcctctttttcaagcccagctgtcgcacaggcccactatcaggggaagaaccacgccaagcgactgcggctggctgaggcacagtcgaactcattctctgagagctccgagctgggccagagaagagctagaaaagagggcaatgagtttaaaatgatgccgaataggcggaatatgtatacagtacagaacaactccggaccatactttaatcccagatcacgacagagaatcccccgtgatctggcgatgtgtgtcaccccctccggtcagttctactgcagcatgtgtaacgtgggagccggagaagagatggaattccggcagcacttggagtcgaagcagcacaagtcaaaagtctccgagcaaaggtaccgcaacgagatggaaaacctggggtacgtgtag

SEQ ID NO: 25973 - DNA, 690 bp, Artificial Sequence
  Description of Artificial Sequence: Synthetic coding sequence
atgaagagctccgacattgatcaggacctgttcacggattcctactgcaaagtgtgctctgcacagctcatcagcgaatcacagagagtcgcccactatgagagcagaaagcacgcctccaaggtgcgactgtattatatgttgcatcctcgcgacggtggctgccctgcaaaaaggctgcggagcgaaaatggtagtgatgctgatatggtagataagaataagtgttgcactctgtgtaatatgagctttactagtgcagttgttgcggatagccactaccaaggaaagattcacgccaagcggctgaaacttcttctaggtgagaaaacaccattgaagacaacagcaactcctttgtccccgctcaagcccccaaggatggacaccgctcccgtcgtagcaagcccatatcagcggagggatagcgaccgctattgcggactgtgtgctgcatggttcaacaacccgctgatggcgcagcagcactacgacggtaaaaagcataagaagaacgctgctcgtgtagctctgctggagcagttgggcaccactctggacatgggtgaacttcgcggtcttcgcagaaactacagatgcaccatatgttccgtgtccctgaatagcattgagcaataccacgcccacttgaaggggagcaagcatcaaaccaatctcaaaaataagtag

SEQ ID NO: 25974 - DNA, 462 bp, Artificial Sequence
  Description of Artificial Sequence: Synthetic coding sequence
atgaaatcctcagatatcgatcaggacctctttactgatagttactgtaaagtgtgtagtgcacagctaattagtgagtcccagagggtcgcgcactatgaatccagaaagcatgcttccaaggtaaggctgtattacatgctccaccccagggacggaggatgtccagctaagcgcctgcggtcagaaaacggctcagatgcagatatggtagataagaacaagtgctgtaccctctgcaatatgtctttcacgagcgccgtagtggccgattctcactaccaggggaaaattcatgctaagagattgaagttgttactcggcgaaaagacccccttgaaaaccactgggctgaggcggaactatcggtgcacaatttgcagtgtatctctcaactctatcgaacagtaccacgcccatttgaaaggatccaaacaccaaaccaacctgaaaaacaaatag

SEQ ID NO: 25975 - DNA, 636 bp, Artificial Sequence
  Description of Artificial Sequence: Synthetic coding sequence
atgaaatcatctgacatcgatcaggacctgttcacggattcatattgcaaagtctgcagcgcccagctcatctctgagtcacaaagagtggctcactatgagagcagaaagcacgcatcaaaggtcaggctgtactacatgttgcatcccagggacggagggtgtccagccaagcgtctgagatctgagaatggcagcgatgctgatatggtcgacaagaacaagtgctgtacactatgcaatatgagctttacttcggctgtcgttgcggattctcactaccagggcaagatccacgcaaaaagacttaaactgctgctcggcgaaaaaacacctctgaaaaccacagccactccacttagccccctgaagcctcccagaatggacaccgcacccgtcgttgcctcaccttaccagaggcgcgattccgatagatattgcggactatgtgccgcatggttcaacaaccccctcatggcccagcagcattacgatggcaagaaacacaagaagaatgccgcacgcgtggcattgcttgaacagctggggaccactctcgatatgggagagcttcggggtctgcggcgtaactaccggtgtacaatttgcagcgtgtccctcaacagcattgagtag

SEQ ID NO: 25976 - DNA, 2685 bp, Artificial Sequence
  Description of Artificial Sequence: Synthetic coding sequence
atgaatagcatgaacccaatgaagcccgcacttccccctgcgcctcacggcgatggaagctttgcgtacgaatcagtgccctggcagcaaagcgctacgcagcccgcaggctcgctgtctgttgtgacaacggtttggggggtggggaacgcaacgcaaagtcaagtgttagggaatcctatggggccagccggtagccccagcggctcaagcatgatgccaggagtggcaggcggatcgagcgccctcacgtctcctcagtgcctcggtcagcaggcattcgcagaagggggtgctaataagggttatgtgcagcagggggtctactcacggggagggtaccctggcgcacctggttttaccaccgggtacgctggtggacctggcggactgggactgccctcccatgctgccaggcctagtaccgattttacgcaggcagcagccgctgccgctgtcgctgcagccgctgctactgccactgctacagctaccgcaaccgtggctgctctccaggagaagcagtcacaggagctcagtcagtacggggctatgggagcaggccagtccttcaatagccaatttttgcagcacggcggaccacgtggaccgtcagtccctgccggtatgaatcccacagggatcggcggagtcatgggtcccagcggtctatctcctctggccatgaacccgacccgcgcagccggaatgacgcctctgtacgccggacagaggttgccacagcacggctatcctggaccaccgcaggcccaaccactgcctcgacagggcgtgaaaagaacctattcagaagtgtaccccggacagcagtacttgcagggcggacagtatgcacccagcaccgcccaattcgcgccatcacccggtcagcccccagccccttccccgtcatatccaggccatcgccttcccttgcaacaggggatgacgcagagcctgtctgtgccaggacctacagggctccactacaagccaacaaggagtatccctggctatcccagtagcccactgcccggaaatccaactccccctatgacgccctccagcagcgttccctatatgtccccaaatcaagaggtcaaatctccttttttgcctgacctaaagccaaacctgaattctctgcatagctctccctctggctcgggaccatgtgatgaactgcggttaaccttccccgtgcgggacggagttgtgctggagccattcagactgcagcacaatttggccgtatcaaatcacgtattccagctccgcgattccgtttataaaaccctcatcatgagacctgatctggagcttcagtttaagtgttaccatcacgaagaccgtcagatgaatactaactggccggcaagtgtgcaggtgagtgtgaacgctactccacttaccatcgagcgaggcgataataaaacgagccacaaaccattatacttaaaacacgtgtgccagcccggaagaaatactatccaaataacagtgacagcctgttgctgctcacacctgttcgtccttcagctggtgcaccggcctagcgtgaggtcagtgctccagggcctgctgaaaaagcgcctcttacctgccgagcattgtatcaccaagattaagcggaatttctcgagcgggacgattcccggaacgccagggcctaatggagaagacggtgtcgagcagaccgccattaaggttagcctgaaatgccctattacttttaggcggatccagctccctgcccgaggacacgactgtcggcacatccaatgcttcgaccttgagtcctacctgcagctgaactgcgaaaggggcacttggcgatgtccagtgtgtaacaaaacagcattgttggagggcctggaagtcgatcaatacatgcttggcatcctcatttatattcagaattcagactatgaagagatcaccattgaccctacttgttcttggaaacctgtcccggtaaagccagatatgcatatcaaggaagagcctgatggaccagcgctgaaacggtgtagaaccgtgagccccgcacatgtgctcatgcccagtgttatggagatgattgctgctctgggccctggagccgctccctttgccccactgcagcctcctagcgttccagctccgtccgactacccgggacagggctcttcatttctgggcccagggaccttccccgagagtttccctccgaccactccaagcacaccgacgctggctgaattcaccccaggacctcccccaatatcctaccaatccgacatcccaagctccttgctgacctccgaaaagtctactgcctgccttccgtctcagatggcgccagccggtcatttagatcctactcacaacccaggtaccccgggactgcacacaagcaacctcggcgctcctcctggaccacagttgcaccattcaaatcctccacctgcatcccgacaatcgttaggtcaagccagcctaggacctacgggcgagctggccttctccccggctactggtgtgatgggtcccccaagcatgagtggggcaggtgaggccccagaacccgcactggacctgctgcctgagctgactaatccagacgaattgctctcttatctgggccctccagatctgcccactaataacaacgatgacctgttgtccctcttcgagaataactag

SEQ ID NO: 25977 - DNA, 2763 bp, Artificial Sequence
  Description of Artificial Sequence: Synthetic coding sequence
atgaacagcatgaatcccatgaagcctgcactgcctccagctccgcatggagatggcagctttgcctatgagagcgtgccatggcagcagtcggccacccagcccgctggcagcttatccgttgtaacgaccgtgtggggagtgggaaatgccacgcagtctcaggtgctcgggaatccaatgggccctgccggaagccctagcgggagctccatgatgcctggtgtcgcgggtgggtccagtgccctgaccagcccccagtgtttagggcagcaggcttttgccgaggggggagccaataagggttacgttcaacagggtgtatatagcagaggaggctacccaggtgcccctggcttcacaaccggctatgccggaggacctggaggacttgggttgcctagccacgcagcgcgaccctccacggatttcacacaggccgctgcagcggctgcggttgccgctgccgcagctacggccaccgcaaccgccaccgccaccgtagcagcactgcaggagaaacagtcccaagagctgtctcagtatggcgctatgggggcaggacaatcatttaactcccaatttctccagcacggcggtccccgagggccttctgtccctgccggaatgaaccctactggaatcggcggagttatggggcctagcgggctttctcctctggctatgaatccaacaagagctgctggcatgacaccactctatgccggacagcgtctgccccaacacggctaccctggcccaccgcaagctcagccactgcccagacagggtgtgaagcgcacttatagtgaggtataccctgggcagcagtacctgcaggggggtcaatatgctccctcaacagcacagtttgctccatccccaggccagccaccagcaccctcccctagctatccagggcatcgacttcctctgcaacaaggaatgacccaaagcttgagcgtacccggacctaccgggcttcactataagcccaccgagcagtttaatggacagggtgcaagttttaatggtggttctgtaagctacagtcaacctgggctgtccgggccaacacgctccatacccggttatccaagttctcccctgcctggaaatcctactccccctatgacaccttcaagctccgtgccctatatgtctccaaatcaggaggttaagtctccttttctccccgatcttaagccaaacctgaactctctgcactcaagcccaagcgggagcggtccctgcgatgaactgcggctgacgttccctgtgcgtgacggagttgtgcttgaaccattccgccttcagcataacctcgcagtgagcaaccacgtgttccaattgcgtgactccgtgtacaagaccctgattatgcggccagatcttgaactccagttcaagtgttaccaccacgaggatcggcaaatgaacaccaattggcccgcatcagttcaggtgtccgtcaacgcgactccactcactattgaacgtggtgacaacaaaacctcccataagcccctctacttgaagcatgtctgtcagcccggtagaaacaccatccagatcacagtgactgcatgctgttgttcccacctgtttgtgctccagctggtccacagaccatcggtcaggagcgtactacagggcttgctcaagaaacgcttgctgcccgcagagcactgtatcaccaagatcaaaaggaatttttcgtccggcacaattcccggtactccgggaccaaatggggaggacggtgttgagcagacggcgattaaggtatctctgaaatgcccgatcactttcaggcggattcagttgcccgctagggggcacgactgccgacacatccagtgttttgacctggagtcctatctgcagctcaattgtgaaagagggacttggcgctgcccagtgtgtaataaaacagcactgctcgaagggcttgaggttgatcagtatatgctaggcatccttatttatattcagaattcggactatgaggagataactatcgacccaacttgctcatggaagcctgttcctgtgaagcctgacatgcatattaaggaggaacctgacgggccagccttgaaaaggtgcagaaccgtgagccctgcccatgtactgatgcccagcgtcatggaaatgattgccgctctgggaccaggagctgccccattcgccccactgcagcctccctctgtgccagctccctcggactacccaggacagggatctagcttccttggacccggtacctttccggagtctttcccccctaccacaccctctaccccgactctggcagagttcacaccgggacccccaccgatctcataccaaagcgacatccctagcagcctcttgacatccgaaaagtccactgcatgtctgccctcacagatggctcctgcgggacatctggatcctacgcacaacccgggaactccgggacttcacacaagtaatttgggcgctccaccaggacctcaattgcatcactccaacccaccccctgccagcagacagtctttgggccaggccagtctcggaccaacaggagagctggccttttcacccgcaacaggggttatgggcccaccatctatgagtggagccggagaggctcccgagccggctcttgacctcctgccagaattaactaaccctgatgaactcttgagttatctggggcctcctgacttgccgacaaataataacgatgacttgttatccttgtttgagaacaactag

SEQ ID NO: 25978 - DNA, 2772 bp, Artificial Sequence
  Description of Artificial Sequence: Synthetic coding sequence
atgaattcgatgaaccccatgaagcccgctttgcctccagcccctcacggcgacgggtccttcgcgtacgaatctgttccctggcagcagagcgccactcagcccgctggcagcctgtcagttgtgacaacagtgtggggtgttggcaatgctacacagtcccaagtgcttgggaacccgatgggccctgcaggctccccatccggatcctcaatgatgccaggagtggccggagggagtagcgctctcacttctccccagtgtctaggtcaacaggctttcgctgaggggggtgccaacaaggggtatgtccagcagggagtgtattctcgcggtggataccctggcgctcccggattcactacgggttacgccggtggcccagggggtctcggacttccttcgcacgctgcgaggccctccacggacttcacccaagctgcggcagccgcagcggtcgctgcagcggcagccactgctaccgccacagctaccgctacggtggctgcattacaagaaaaacagtctcaggagctgtcacaatacggtgctatgggcgcagggcagtcattcaactcgcagtttcttcagcacgggggacccagagggccatccgtgccggctgggatgaatcccaccggtatcggaggcgtgatgggcccttccggcctcagccctctggccatgaaccccaccagagcggcaggcatgacaccactttacgcaggtcagaggctgcctcagcacggttacccaggtccccctcaggcacaaccactgccacggcagggcgttaaacgaacctactcggaagtatatccagggcaacagtatcttcaggggggacaatatgcgccttcaaccgctcagttcgcacctagtcctggtcagcctccagccccttcaccaagttaccctgggcatagactgcctcttcaacaaggaatgactcagtccctgagtgtcccgggtcccacaggtctgcactacaagcccactgagcagttcaacggccagggcgcaagctttaacggcggatccgtctcctatagccagcctggtctgtctgggcctactcggagtatccccggatatccaagcagtcctctcccaggaaatcccacccctcccatgactccgagttccagcgtgccatatatgtcacccaatcaggaagtcaaatcccctttcctacctgacctcaagcctaatctgaatagcctccactccagcccctcaggaagcggcccttgcgatgagctccggctcactttcccagtacgtgatggagtggtgcttgaacctttccgcctccagcacaacctcgcagtgagtaatcatgtgttccaattgagagactctgtgtacaagaccctcattatgcgcccagacctggaattacagttcaagtgctatcatcatgaggacaggcaaatgaataccaattggccagcttctgtgcaggtgagcgtgaacgccacacccctgacaatcgaaaggggagacaacaaaacatctcataaacctctttacctgaagcacgtctgtgctcgtccacagcatcatcccagtccgagtcctccggcagcggcttgtgtgagctgtagccacctgttcgtcctgcagttagtgcaccggccttctgtcaggtctgtgctgcagggactccttaaaaaacgactgttaccagcagagcactgcataaccaaaatcaaaagaaatttctcttctggcacaattccaggaacccccggacccaatggggaagacggcgtagaacagacagcaattaaggtgagcctgaagtgtcccatcacatttaggcgtatccagcttccagccagagggcatgattgccgccatatccagtgcttcgatctggagagttatctgcagcttaactgcgaaagaggaacgtggcggtgccctgtgtgtaacaagaccgcccttcttgaggggctggaggtggatcagtacatgctaggaatcctcatatatatccagaacagcgattatgaggaaatcacaatagaccccacttgcagttggaagcccgtgcctgtgaagcctgatatgcatataaaggaggagcctgacgggcctgcactgaaacgctgtaggacagtgtcacctgcacatgtgctcatgccatctgtgatggaaatgatcgctgccctgggccctggggctgcccctttcgcccctctgcagccaccctcagtccccgctccttcggactaccccggacaggggtctagttttctcgggccaggaacctttcctgagagctttccaccgaccactccctccacccccactctcgccgagttcactccagggccaccccctatatcctaccaatcggacattccctcctctctcctcacttccgaaaaatccaccgcttgcctgcccagccaaatggccccagcgggacacctagatcctacccataaccctggcactcccggtctacataccagtaatctcggggctcccccaggaccccagctccatcattccaatccgcctcctgcgagccgacagtctctggggcaggcttcacttgggccaaccggtgaacttgccttctctcctgctaccggcgtgatgggcccaccaagtatgagcggtgctggggaagccccagagcccgctcttgacctgctgccggagttgactaatcccgatgagttgctgtcctacctggggcctccagacctccctaccaataataatgacgatctcttatctctatttgagaacaattag

SEQ ID NO: 25979 - DNA, 2763 bp, Artificial Sequence
  Description of Artificial Sequence: Synthetic coding sequence
atgaatagtatgaatcccatgaagcccgcactgccaccagcaccacacggtgatggctccttcgcatacgaatcggtgccttggcagcaatccgccactcaaccggctggtagcctgtccgtggtcacaaccgtgtggggcgtaggtaacgcaactcaatcccaagtgctaggaaaccccatgggccctgccggaagcccatcaggcagtagtatgatgccaggtgtagctggcggatcatcggcactgacatccccgcagtgcctgggccagcaggcttttgcggagggcggagccaacaaggggtatgttcaacagggtgtctactctaggggcggatatcccggtgctcctggctttacaacgggatatgctggcggaccgggaggcctcggacttccatcccatgctgccagaccatctaccgatttcacacaggcagccgcagcggcagccgttgctgccgctgctgccaccgctaccgctaccgccacggcgactgtcgcagctctgcaggagaaacagagtcaggaactgtctcaatacggagccatgggggctggacagagctttaattcccagtttctccaacatggagggccaagaggacctagcgtacccgcaggtatgaatcctacaggcattggaggggtgatgggcccttctgggctgtcccccctggcaatgaacccaactagggccgcagggatgacacccctgtacgcgggacagaggctgcctcagcacgggtacccgggaccccctcaggctcagccgcttccaaggcagggcgttaaacgaacctatagcgaggtgtatcccggacagcagtacctgcaagggggtcagtatgcaccctcaaccgcccagtttgcacccagtcccggacagcccccagccccatctccaagctaccccggtcatcgtttgcctctgcagcagggtatgacccagtccctgagcgtgccaggtccaaccgggttgcattacaagccaactgaacagttcaacgggcagggagccagcttcaatgggggatccgtttcttactcccagcccggactgtccggccctactagaagtatacccggataccccagcagccccctgcccggaaatcccactccacccatgaccccttcgtcctcggtgccctatatgtcccccaaccaggaagtcaagagcccttttttgccagacctgaagcccaatctgaattctctacatagctcccccagtggctctggcccttgtgacgagctcagattgacattccctgttagggatggagtggtgctggagccttttcgcctacagcacaacctggccgtaagtaatcacgtctttcagctccgcgactcagtgtacaaaacgctcatcatgcggccagatctcgagctgcaatttaaatgttatcatcatgaagatcgtcaaatgaacaccaactggcccgcttctgttcaggttagcgtgaacgcgacccccctaacgattgaaaggggtgacaataagaccagccacaagccactgtatctcaagcatgtatgtcagcccggacgaaacaccattcaaattacagttaccgcttgctgctgctcgcatctcttcgtcctgcagttagttcataggcccagcgtgcgctccgtcctgcaaggactgcttaagaagagattactgccggctgaacactgcatcactaagatcaagagaaatttttcatcagggactatacctggaacaccaggcccaaatggggaagacggtgtggaacagaccgccatcaaagtgtcgttgaagtgtccaataacattccgacgcatacagttacctgccaggggccacgactgtaggcatatccagtgctttgacttggagtcatacttgcagcttaattgcgagcggggaacctggagatgccccgtctgtaataaaacggcactactggaaggactggaggtcgaccaatacatgctggggattttgatatacattcagaactccgattacgaagagatcacgatcgacccgacttgctcttggaaaccagttcctgttaaacctgatatgcacataaaggaagagcccgacgggcctgccctgaaacgctgtaggactgtttcaccagcccatgtcctcatgccttccgtaatggagatgatcgctgctttagggcctggagccgcacccttcgcacctcttcagcctcccagcgtgcccgctccaagcgactaccccggtcagggctcaagttttctgggcccaggcacttttcccgaatcttttcctccaactacgcctagtacaccaactttggccgaatttacacctggccctcccccaattagttatcagtctgacatccccagctcactacttacttccgagaagtccacagcatgtttgcccagccaaatggcaccagctggtcatttggaccctacccacaacccaggcacacccggtctccacaccagcaacctcggagccccaccgggaccacaactgcaccacagtaaccctcctcctgcctctcggcagtctctaggccaagcctcccttggcccaaccggagaactcgctttttcccccgctactggggtcatgggtcctccttccatgagcggcgctggcgaagccccagaacccgcattagacctgctgcctgagctgaccaaccccgatgaactcttgagctatctcggtcctcccgatctccctacaaataataacgacgatttgctctctctctttgagaataattag

SEQ ID NO: 25980 - DNA, 273 bp, Artificial Sequence
  Description of Artificial Sequence: Synthetic coding sequence
atgaattccatgaatccaatgaagccagcattaccaccagcaccccacggagatggtagtttcgcctacgaatcggttccctggcagcagtctgccacccagccagcgggttcactcagtgttgttacaaccgtatggggtgttgggaacgcaacccagagtcaagttctgggcaatcctatggggccagcgggaagcccttcaggcagctcgatgatgcctggggttgcgggagggtccagtgcattaactagcccacaatgcctgggctag

SEQ ID NO: 25981 - DNA, 3429 bp, Artificial Sequence
  Description of Artificial Sequence: Synthetic coding sequence
atgaaagagcccctcttgggcggagagtgcgacaaagcagttgcttcgcagttaggacttctcgacgagataaagacggagccagacaatgcacaggagtattgccataggcagcagagtcgcacccaggagaatgaactgaagattaacgccgtgttcagtgaatctgcttcccaacttactgccggaattcagcttagcctagcttcatcaggcgtgaataaaatgctgccttccgtctcgacaacagccattcaggtaagttgtgccggttgcaagaagatcctgcaaaaaggccagacggcttaccaaagaaagggctcagcccagcttttctgcagcatcccatgcatcacggaatatataagctctgcatcctcccccgtaccctctaagcgaacctgcagcaattgttctaaggatatcctaaaccccaaggatgttatctctgtccaactggaggatactacttcgtgtaagacattctgttctttgagttgtttgagttcctacgaggagaagagaaaaccattcgttactatctgtacaaattcaatcctgaccaaatgtagcatgtgccagaaaaccgcgataatacagtacgaagtaaaatatcagaatgttaagcacaatctctgctcaaatgcttgcttgtccaagtttcattccgctaataatttcatcatgaattgttgcgagaattgtggcacctactgttatacatcttcttcactgagtcacatccttcagatggaaggccagagtcattacttcaacagctcaaaatctatcactgcatataaacagaagcctgccaagcctttgattagcgtgccatgcaagccactgaaaccctctgatgagatgatcgagacaacctcggatctgggcaaaaccgaactgttttgctcaataaattgcttctcagcctatagtaaagctaagatggagagcagctcagtgtcagtcgtctccgtggtgcatgatacgagtactgaactgctgagtccaaagaaggatactactcccgtgatttccaatatcgtgtctctagccgacaccgatgtagctcttccaataatgaacactgatgttctgcaagacacagtgagctccgttacagcaaccgcagacgtgattgtcgacctgtccaagtcgagtccatccgagcctagcaatgccgtagcttcatcgagcaccgagcaaccctccgtaagcccctcctcatccgtcttcagccagcacgccatcggatcctccacggaggtgcagaaagacaatatgaagtccatgaaaatctctgacgaactttgccaccctaaatgcacctcgaaggtgcagaaggtgaagggcaaatcgcgaagcataaagaagagctgctgcgccgacttcgagtgcctcgaaaatagcaagaaagatgtggcattctgctactcttgccagcttttttgccagaaatactttagctgtggaagggaaagcttcgccactcatggaacatccaactggaagaagaccctggagaagtttcgtaagcatgagaagagcgagatgcatctgaagtcactcgaattctggagggagtaccaattctgtgacggagcagtcagcgatgatttgagcatccacagcaagcaaattgaggggaacaagaagtacttaaagcttatcatcgagaatattttgttcctgggtaagcaatgtcttccattgcgaggcaacgaccagagtgtgtcttctgtcaacaaaggaaactttctggagcttttggagatgagggctaaggacaaaggcgaggaaacctttcgcctgatgaatagccaggtcgacttctataactccacacagattcaaagtgatataattgagattatcaaaactgagatgttacaggacattgtgaatgaaattaacgactcttctgctttcagcatcatatgcgatgaaaccatcaattctgcaatgaaggaacaactctcaatctgcgtccgatacccacagaagtctagcaaggcgattttaattaaggagcgctttctggggttcgtcgacaccgaagaaatgacaggcactcatctgcataggacaattaaaacatacctgcagcagattggcgttgatatggataagattcacgggcaggcatatgattccactactaatcttaagatcaagttcaataaaattgcagcagaatttaagaaagaggaacctcgcgctctctatatacactgctacgcacatttcctggacctgagcatcatccggttttgcaaagaggtgaaagaactgcgaagcgctctgaaaactctctcttcactgtttaacactatatgtatgagcggagagatgctggccaactttcgcaacatttaccggctttctcagaataagacctgtaaaaagcacatatcccaatcttgttggacagttcacgaccgcactttgctgtctgttatcgactctctccctgagattatcgaaacattagaggtaatcgcgagccactcaagtaataccagctttgccgacgagctctcccacctactgactctggtctctaagtttgagtttgttttctgcctcaaattcttgtatcgggtgctaagtgtgacaggaatcttgagcaaggaactccagaataagacaattgatatctttagtttaagctctaaaattgaggcaattctggaatgcttgtccagcgagcggaacgatgtgtacttcaaaacaatctgggacggcacggaagaaatttgccagaagatcacatgtaagggctttaaggtggaaaagcccagcctgcagaagagacgaaagattcagaaatccgttgatttaggaaactcagacaacatgtttttccctacttccactgaagagcagtataaaatcaacatttattaccagggcctcgacacgatcctgcagaacctcaaactgtgttttagtgagttcgattactgcaaaatcaaacagatttccgagctgttgttcaaatggaacgaaccattgaatgaaactactgccaagcatgtgcaagagttttacaaattggacgaggatataatacccgagctgaggttctatcggcattacgcaaaattgaatttcgtaatcgacgattcttgcattaactttgttagcctcggatgcctttttatacagcatggcctgcactcgaacattccctgcctgtccaagctgttgtacatagccttatcatggcctataacaagtgcctctaccgagaatagcttttcaacacttccacgtctcaaaacctacttgtgtaacaccatgggacaggagaaactgactggtccagctcttatggccgttgagcaggagctggtcaataagttgatggagccagagcggctgaatgagatagtggagaaattcatttcccaaatgaaggaaatatag

SEQ ID NO: 25982 - DNA, 3204 bp, Artificial Sequence
  Description of Artificial Sequence: Synthetic coding sequence
atgctgccatcggtcagcaccaccgctatccaggtgtcatgcgccggatgcaaaaaaattctccaaaaaggacagacagcctaccagaggaagggatctgcacagttgttctgctcaatcccttgcatcacagaatacatcagcagcgccagttctcctgtgccaagcaagaggacgtgctctaactgctctaaggatattctaaatccgaaagatgtgattagtgtgcagctggaggataccacctcttgcaagaccttttgcagtctctcctgcctgagttcatacgaagaaaaacgcaagccattcgtcaccatatgtacgaattccattttgacgaaatgctcgatgtgccagaaaaccgcgatcatacaatacgaggttaagtaccagaacgttaaacacaacctctgctccaatgcctgcctctcgaaattccactctgcaaataatttcatcatgaactgttgtgaaaactgcggtacttactgctacaccagtagctccctgtctcacatcctgcaaatggagggacaatcccattactttaactccagcaaatccattactgcttataagcagaagcccgcaaagcctttaatttcagtgccttgcaaaccgctgaagccgtctgacgagatgatagaaactacgtctgacctgggtaagactgaactgttttgtagcattaactgttttagcgcatattctaaggcgaagatggaaagctctagcgtgtcagtagtcagtgtggtccacgatacgtcgacagagctgctgtcccctaaaaaggacaccactcccgtgatctccaacattgtgtctttggcggataccgacgtcgccttacctataatgaatactgacgtactgcaggacacagttagctctgtgacagccacagccgatgtgatcgtcgacctcagtaagtccagcccttctgagcccagtaatgccgttgccagttcatccaccgagcagccctccgtcagtccgagtagctcagttttctcacagcacgccattggctcaagcaccgaagtccagaaagataacatgaaatcaatgaaaatttccgatgagctttgccatcccaagtgcaccagtaaggtgcaaaaggtcaagggtaaaagtcgctctattaagaagtcttgctgcgccgacttcgaatgcctggagaacagcaagaaagacgtagctttttgttatagttgccagctgttctgccaaaaatacttctcgtgcggtagggagtcctttgccacccatggcacatctaactggaaaaagacactcgaaaagttccgaaagcacgagaaatcggagatgcacctcaaatccctagagttttggcgagaatatcaattctgcgatggcgcagtgtcagacgacctgagtattcattccaagcagattgaaggcaataagaaatatctgaagcttatcattgagaacatcttgtttctaggaaagcagtgcttgccgcttagggggaatgaccagtctgtgagttcagtgaacaaaggaaacttcctggagctgctggagatgcgggcaaaagataaaggagaggagacgtttcgcttgatgaactcccaagttgacttttataattcaacacaaatccagtccgacataattgaaataattaagacggaaatgctacaggacattgtgaacgagatcaacgatagctctgctttttccattatctgcgacgaaaccatcaactccgcaatgaaggaacagctgagcatctgtgtgcgatatccacaaaagagcagtaaagccattctcatcaaggagaggtttcttggattcgtcgataccgaagagatgacaggaacacatttgcatcgcaccatcaagacatacctccagcagattggggtggacatggacaagatccacggacaggcctatgattcaactactaatctcaaaataaaatttaacaaaatcgcggcagagtttaagaaagaagaaccacgcgctctgtacattcattgctacgcacattttttagacctttccattattcgcttttgcaaggaggtcaaagaactgcgctcagcgcttaaaacactatccagcctgttcaacacaatctgcatgtcaggcgaaatgcttgcaaacttcagaaatatctataggctgtctcaaaacaagacgtgtaaaaagcatatcagccagtcatgttggacagtgcacgatcggactctactgtcggtgattgactccctccccgaaatcatagaaaccctggaggttatcgcctcacatagctccaatacatccttcgcagacgagctctcccacctgctgacactcgtgtccaaattcgagtttgtgttctgtctgaaatttctttatcgtgtgctgagcgtgaccggaattctatccaaagaattacaaaacaagacgatagatattttctcacttagctctaagatcgaagccattcttgagtgtttatcgagcgagcgtaatgacgtgtacttcaaaaccatctgggatggaacggaagagatttgtcagaagataacttgtaaagggttcaaagtcgagaaaccatcgttgcagaagcgcaggaaaatccaaaagagcgtagaccttggtaactcagacaacatgtttttccctacaagtacagaggaacaatataagatcaacatctactatcagggattagacactatccttcaaaatctgaaactgtgctttagcgagtttgactactgcaaaatcaaacaaatttcagagctcctctttaaatggaacgaaccgctcaatgaaacgacagctaagcacgtgcaggaattttataaactggacgaggacattattcccgagttgcgattttaccggcactacgccaaacttaacttcgtgatcgacgacagctgcattaactttgtctcgctagggtgtctgttcattcagcatggtctgcattcaaacataccctgtctctcgaaactgttgtatatagcgctgagctggcctatcacctccgcatcaactgagaactcattttcaaccttaccccgactcaaaacatacctgtgcaatactatggggcaagagaagctgaccgggcctgctctgatggccgtagaacaggagcttgtgaacaagctcatggaaccagagcgactgaatgaaatagtcgagaagttcatatcacagatgaaggagatatag

SEQ ID NO: 25983 - DNA, 3429 bp, Artificial Sequence
  Description of Artificial Sequence: Synthetic coding sequence
atgaaagagcccctgctggggggagaatgtgataaggcagtggctagtcagctcggacttcttgacgagattaagacagaacccgacaacgcccaagaatattgtcacagacagcagtctagaacgcaggaaaatgagttgaagatcaacgctgtattcagtgaaagcgccagccagctgaccgctggtattcaactgtcattggcgagctctggggtgaataagatgttgccgagcgtctcaaccacagccattcaggtgtcctgtgccggatgcaagaagatattacaaaagggacagaccgcatatcagagaaaggggtccgcacagcttttctgtagcatcccatgcattaccgagtacattagcagcgcatcatcaccagtgcccagtaaaaggacctgctccaattgtagcaaagacatactgaatccgaaagatgttatctctgtgcagctggaggataccacatcatgcaaaactttctgttctttgagctgcctttcaagttacgaagaaaagcgaaagcccttcgtgactatttgcaccaactctatcctgaccaaatgttctatgtgccagaaaaccgccatcatccaatacgaagttaagtatcaaaacgttaaacacaatctctgttccaatgcatgcctgtcaaagtttcacagcgccaacaacttcatcatgaactgttgcgagaattgtggaacatactgctacacttctagttccctgtcacatattctccaaatggaaggtcagagtcattactttaacagctctaaatccataactgcttacaagcaaaagccagctaaacctcttattagcgtgccatgtaagcccctcaagccatcagacgaaatgatagagaccacctccgatctggggaaaaccgagcttttctgcagcatcaactgcttttcggcttattccaaggctaagatggaaagtagcagcgtgtccgtggtttctgtggtgcatgatactagcacagagctgttgtcacccaaaaaggacaccacacctgtcatcagcaatattgtcagcctggcagatacggacgttgcactcccgatcatgaacacagacgtgctccaagatacagtctccagcgtgacagcgacagctgatgtcatcgtggacctgtcgaagagctcaccgtctgagccttccaacgcagtggcttctagctcaacggaacagccatctgttagtccatcctctagcgtgttttctcagcacgctattggatcatccaccgaggtgcagaaggataacatgaagagcatgaaaatatctgacgaactttgtcaccctaagtgtacgagtaaagttcagaaggtgaagggaaaatctcgcagcatcaaaaaaagttgttgcgctgactttgagtgtctggagaacagcaaaaaagatgtggcgttttgttactcctgccagctcttttgccagaagtatttctcttgtggacgcgagagcttcgccacacatggcacctcaaactggaagaaaacactggagaagttcaggaagcacgagaagtcagagatgcacctgaagtctcttgagttctggcgagaataccagttttgcgacggggctgtgtccgatgacttgtccatacacagcaagcagatagagggaaataagaagtatttaaagcttattatagaaaatatcttattcctcggcaagcagtgtttgcctttacgcggaaatgatcagagcgtctcgtccgtcaataagggcaatttcctcgagctgctagagatgcgggcaaaggacaaaggcgaggaaacattccgcctcatgaatagccaggtagacttctacaacagcactcagatccagtccgacatcatcgagatcataaaaaccgagatgttgcaagatattgtgaatgaaatcaatgatagttctgcttttagcataatatgcgacgagacaataaattctgccatgaaagagcagcttagcatctgtgtgaggtatccacagaaaagttcgaaggctattctcattaaagagagattcttagggttcgtggatactgaggagatgaccggcacccatttacatcgcactatcaagacatatctgcagcagatcggagtggatatggacaagatacacgggcaggcctacgacagtaccaccaatctgaaaatcaaatttaacaagattgccgctgagtttaaaaaggaagaaccacgcgctctttacatccactgctatgcacatttcctcgaccttagcatcatcagattctgcaaagaagtgaaggagctgcgtagcgcattgaagaccttaagttcactcttcaacactatatgcatgtctggcgaaatgctggccaacttcagaaacatataccggcttagtcagaataagacctgtaaaaagcacatctcccagtcttgttggacggtgcacgaccgaaccctgctctcagtgatagatagcctgccagagatcatcgagacactcgaagtgatcgcctcccacagcagcaacaccagctttgcggatgaactttcgcacctactgactctggtctccaagttcgaatttgtattttgcctcaagttcttgtaccgggtcctgtctgtcactggtattctgtccaaggaacttcagaataaaaccattgacatttttagcctgtcctccaagatcgaagcgatcctggagtgcctgtcatccgaacgcaatgatgtttattttaagactatatgggatggaaccgaagagatctgtcagaagatcacttgtaaggggttcaaggtggaaaaaccttccctccaaaaacgacgcaaaattcagaagtccgtcgacttgggaaactccgacaatatgttctttcccacaagcaccgaagagcagtacaaaattaacatctactaccagggcttggataccatccttcagaatctgaagttatgttttagtgaattcgattactgcaaaatcaaacagataagcgagctcctcttcaaatggaacgagcctctgaatgagacaactgcaaagcatgttcaggaattctataagctggatgaggacatcatccccgaattgagattctatcgacattacgcaaagctcaacttcgtcattgatgattcgtgcattaacttcgttagcctgggatgcctttttatacagcacggtctgcactccaacatcccttgcctttccaagttgctgtacatcgccctgagctggcccattactagcgccagtaccgagaactccttctctaccctccctcgcctgaagacatacctgtgtaatacaatggggcaggaaaagctgaccgggcctgccttgatggccgtcgaacaggaactggttaacaagctcatggaacctgaacggctgaacgaaattgtggaaaagtttattagtcaaatgaaggagatttag

SEQ ID NO: 25984 - DNA, 1389 bp, Artificial Sequence
  Description of Artificial Sequence: Synthetic coding sequence
atgaaggaaccactgctaggcggagagtgtgacaaggcagttgctagtcagttggggctcttggatgaaatcaaaactgagccagacaacgcacaagaatattgccacagacaacagtcccgtacgcaggagaacgaactgaaaatcaacgccgtcttttcagagtccgcctcccagctgactgctgggattcagctgtctctcgcttcgtccggtgtgaataaaatgctgccctccgtaagcaccactgcaatccaggtgagttgtgccggttgtaagaaaatcctgcagaaggggcagacagcctatcagcgcaagggatccgctcaattgttttgtagcatcccatgcatcaccgaatacatctcatccgcctctagtccagtaccaagtaaacgaacctgcagcaactgttccaaggatatcctgaatcctaaagatgtcatctccgtgcaactggaagataccaccagctgtaagactttctgttcgctgtcttgcctctcttcttatgaggagaagagaaaaccattcgttacaatatgcacaaattccatcctaacaaagtgctccatgtgccagaagactgctatcatccagtacgaagttaagtatcagaatgtgaaacataacctgtgttcaaacgcctgcctatcgaagttccattccgcaaataacttcattatgaattgttgtgaaaattgtgggacctactgctatacctcctctagtctgtcccacatcctgcagatggagggccaatcacattacttcaactcttcaaagtctattaccgcttacaagcagaaacccgcaaagcccctgatatcagttccctgtaagcctctcaagccctctgatgagatgatcgagaccacttccgacttgggtaagaccgaactcttctgttctattaattgtttttccgcttactctaaggccaagatggagtcctccagcgtgagtgtcgtatcggtcgtgcatgacacaagcaccgagctgctgagccctaagaaagatacgacacctgtcatcagcaatatcgtctctctcgccgataccgacgtagccctccccatcatgaacaccgacgtgctccaggacaccgtgtcctccgtcactgctacggccgatgtgatcgtggaccttagcaagtccagccccagcgagcctagtaacgcagtcgcttcttcctccacggaacagcctagcgtcagccccagttcgtcagtctttagccagcacgcgattggttcttctaccgaagtgcagaaggacaatatgaaaagcatgaagatatcagatgagctctgtcaccctaagtgcactagcaaggtgcaaaaggtgaagggcaaatcgaggagtatcaaaaaaagctgttgtgcctag

SEQ ID NO: 25985 - DNA, 2010 bp, Artificial Sequence
  Description of Artificial Sequence: Synthetic coding sequence
atggaaaaatgttcagtgggcggactggaattaaccgagcagacgccagccttgttgggcaacatggccatggccacatccctcatggacataggtgactctttcggccatcctgcctgtcctctcgtgtcccgctctcgaaattcgcctgtcgaagatgacgacgacgacgacgacgtggttttcatcgagtccatccaacctccatctatctccgcccctgccattgctgaccagagaaacttcatatttgctagttccaaaaacgagaaaccacaaggaaattattctgtgatcccaccctcttctcgcgaccttgccagtcagaaggggaacatttcagagaccatcgttatcgatgacgaagaagacatagagactaatggaggagctgaaaagaagagttcatgcttcattgagtggggtctcccaggtacgaagaacaaaaccaacgatttggatttctctacctctagcctgagtcgcagtaagactaagaccggcgtgaggcccttcaatcccggacggatgaacgtggccggtgatctgtttcagaacggcgagtttgcaacacatcatagccctgactcatggattagccagagcgcctcttttcctagcaaccagaaacaacccggagtggacagcttatcgccagtagccctgctacgaaaacaaaacttccagcccacagcacagcagcagctcactaaaccagccaaaattacatgcgcaaactgtaagaagccccttcagaaaggacagaccgcataccaaaggaagggctccgcccacctcttctgttctacgacatgtctgagttctttctctcataaacgcacccagaatacccgcagcatcatctgtaaaaaagatgcatccactaagaaggccaacgttatcctgcccgtggagtcatccaagtctttccaggaattttatagtaccagctgcctgagcccctgcgaaaataactggaacctgaagaagggggtctttaataagtcaaggtgtacgatatgctcaaaactagcagagatccggcacgaggtgtctgtcaataatgtaacccataaactgtgctctaatcactgcttcaataagtaccgccttgctaatggcctaatcatgaattgttgtgagcactgtggcgagtacatgccttctaagtcgactggaaataatatcctggtgatcgggggacagcagaagaggttctgttgccaatcttgcattaacgagtataaacagatgatggaaacgaagtctaagaaacttaccgcttctgaaaacaggaaacgcaatgccttcagggaggaaaatgaaaaacagctatacggtagtagtaacacgctgctgaagaagatcgaggggatcccagaaaagaaggagaagacctcccagctacagctgagcgtggagtgcggcactgacacactgctcattcaggaaaacgtaaacttacccccatcaagtacatctacaattgctgataccttccaggaacagctggaggagaaaaatttcgaagattccatcgtgccggtggtgctgtcagccgatcctggaacatggcccaggattctgaacattaaacagcgcgacaccctggtggaaaatgtgccccctcaagtcagaaactttaacttccccaaagacaacacaggacgaaagttctctgaaacatactacacacgtatcctgccaaacggagaaaagaccacccgctcatggctgctctattctacaagcaaagatagcgttttctgtctgtattgcaagctctttggagaaggtaaaaaccagctgaaaaacgagaacggatgcaaggactggcagcaccttagtcacattctcagcaaacacgaggaatcagagatgcacgtcaacaactcagtgaaatatagtaagctcaaaagcgatctgaagaagaataaggccattgatgctgccgagcaccgcctgtatgaaaacgaaaaaaacgatggcgtgttgctcctgtatacatag

SEQ ID NO: 25986 - DNA, 1149 bp, Artificial Sequence
  Description of Artificial Sequence: Synthetic coding sequence
atggaaaagtgctcagtgggtggcctcgagctcaccgaacaaacccctgccctcctgggcaatatggccatggctacaagtctcatggatatcggcgattcctttggtcatcccgcatgtccgttggtgtcaaggagccggaattcacccgtagaagatgacgatgatgacgatgatgtggtctttatcgagagtatccaaccaccatctatctccgcacctgctattgctgatcagagaaacttcatctttgccagcagtaaaaatgagaaaccgcaaggtaattacagtgttatacctccttcctctcgggacctcgcatcacaaaagggcaacattagtgagaccatcgtgatagatgacgaggaggacatagagaccaacgggggagccgaaaagaagagcagttgcttcatagagtggggtctgcctgggactaagaataagacgaacgacttggatttttccacttcatcactcagtaggtctaaaactaaaactggcgtgcgacccttcaaccccggacggatgaacgtagccggtgacctgttccagaacggtgagtttgccactcatcacagccccgacagctggatttcacagagtgcctcctttccgtctaaccagaagcagccaggggttgattccctatcgcctgtggctttactcagaaaacaaaactttcagcctacagcccagcagcaactgaccaagccggctaagatcacctgcgcaaattgtaagaaacccctccagaaaggccagacagcgtaccagcgcaaaggtagcgcacacctgttctgctctacaacctgcctctcgagtttctctcacaagaggacacagaacactcggtcaattatctgtaagaaggacgcctcaacaaagaaggctaacgtgatccttccggttgagagcagcaagtcattccaggagttttacagcacctcctgtctgagcccctgtgaaaacaattggaacctgaagaaaggtgtcttcaacaagagccgctgtacaatttgctccaagctagcggaagtgtggatattcatcccaaaactattattccggctcactgtgatcatactcactttcaagtgctactacgtattattccacctgcataatgctagagtcttggatgtgtag

SEQ ID NO: 25987 - DNA, 627 bp, Artificial Sequence
  Description of Artificial Sequence: Synthetic coding sequence
atggaaaagtgctccgtcggaggactggagctcaccgagcaaacaccagcactgctgggcaatatggcaatggctacatccctcatggacattggcgatagtttcgggcaccctgcatgcccgttagtgtcccggtcccgcaactcgcctgtggaggacgacgatgatgacgacgacgtcgtttttatagaatcaatccagcctcctagcattagtgccccagctattgcggatcagcggaacttcatctttgcaagttccaaaaacgaaaagcctcaggggaactactcagtgattccgccatcttccagggatctagcttcacagaagggcaacatatcagagacaatcgtcatagacgatgaagaagacattgaaaccaacggcggtgccgagaaaaaatccagttgcttcatcgagtgggggctgcccggtacgaaaaacaaaacaaacgatctcgattttagcactagtagcctgtctaggagtaagacaaaaaccggcgtccgacccttcaaccccggtcgtatgaatgtggcaggcgatctattccaaaatggggagtttgccacacatcactctcctgaaatgcacctgcagaggcggctgatgagttttttccagtag

SEQ ID NO: 25988 - DNA, 513 bp, Artificial Sequence
  Description of Artificial Sequence: Synthetic coding sequence
atgaaagaacccctggatggtgagtgcggtaaagccgtcgttccccagcaggaactgctcgataagattaaggaggaacccgataacgcgcaggagtacgggtgcgtgcagcaacctaaaacacaggaaagcaagcttaaaataggcggagtgagctccgtgaacgagcgcccaatagctcaacagctaaaccctggattccagctgagcttcgcttcttctgggccatccgtactgctcccgtcggtacctgcggtggcaattaaggtgttttgttctggatgcaaaaagatgttatataagggtcagacggcttatcacaagactggctccacgcagcttttttgtagcactcgctgtattactcggcacagttcaccagcttgcctacctcccccacctaaaaagacatgtactaactgctcaaagtacaagattttaaatatcccattttactttaccttcttcctggtgtgtattctcttctcttccaatatcctattgatcctttag

SEQ ID NO: 25989 - DNA, 3978 bp, Artificial Sequence
  Description of Artificial Sequence: Synthetic coding sequence
atgaaagaacccctggacggcgagtgcgggaaggctgtggtaccacaacaggaactcttagataagataaaggaggagccagacaatgctcaggaatacggatgtgtgcagcaacccaaaacccaggagagcaaattgaaaatcgggggtgtgtctagcgtgaacgaacggccaattgcgcagcagctgaatccgggatttcagctatctttcgcatcgagtggacctagcgtattgttgccttccgtgcctgccgttgcgatcaaagtgttttgttcaggatgtaagaagatgctctacaaaggccagaccgcataccacaagacaggatccactcagctcttctgttcgactagatgtattactcgtcattccagccctgcatgtctgccaccccctccaaagaagacgtgtaccaattgctcaaaagatatcctgaatccaaaggacgtgattaccaccaggtttgagaatagctatccaagcaaggatttttgctcccagtcatgtctgtcctcttacgaacttaagaaaaagccggtggtaactatttacaccaagtccatctctaccaagtgttcgatgtgtcagaaaaatgcggacacccggtttgaagtgaaatatcagaacgtggtccacggtctgtgctccgatgcgtgtttttccaagtttcactctacaaacaaccttactatgaattgttgcgagaactgtggcagctactgctactcgtctagcggcccatgccagtcccaaaaggtgttttcatctacatcggtgactgcatataagcagaactcagcccagatacccccttacgccctgggcaagtccctgcggcctagcgcagagatgatagaaaccactaacgacagcgggaaaactgaattattttgttccattaactgcctgtcagcatacagagtgaaaacagtgacctcttccggcgtgcaggtgagttgtcatagttgcaagacaagtgccattccacaataccacttggcaatgtccaacggtactatctattccttttgcagcagcagctgtgttgttgcctttcagaacgtgttcagcaaacccaagggtacgaactctagcgccgtccctctatctcaagggcaagttgtggtgagtccccctagcagtagaagtgccgtaagtatcgggggtggcaacacctccgcagttagtccaagctctatacgaggctcggctgcagcaagcttgcagccactagctgagcagagccagcaggttgccctcactcacaccgtggtaaagctgaaatgtcagcactgcaaccatctgtttgcaaccaagcctgaactcctcttttacaagggcaagatgttcttgttctgcgggaagaattgttccgatgagtataaaaagaagaataaggtggtggcgatgtgtgactactgtaaactgcagaagatcatcaaggaaacggttcgattctctggggtggataagcctttttgctcagaggtgtgtaaattcctctcggcccgtgattttggcgaacgttggggtaactactgtaagatgtgtagttattgttctcagacgagtcccaacttggttgaaaaccgcctggaggggaagcttgaggagttttgttgcgaagactgtatgagcaagttcacagtgctgttttaccagatggcgaaatgcgatggttgtaagaggcaggggaaactctctgaaagcattaaatggagggggaacattaaacacttttgcaatcttttttgcgtcttggaattctgtcatcagcagattatgaatgattgcctaccacagaacaaggttaacatctcaaaagctaagaccgctgtgaccgagctgccctctgctcgtacggatactactcccgtgatcactagtgtgatgtctcttgccaaaattccagccacattatccacaggcaatactaattctgtcttaaagggagcagtgaccaaggaggcagcaaaaattatccaggacgagtccacacaggaggatgccatgaagttcccgagcagtcagagttcacaacccagtcggctcctgaaaaacaaaggaatttcctgcaaaccagtgacccagacaaaggctacatcctgcaagcctcacacacagcacaaagagtgccagacagatctacctatgcccaacgaaaagaacgatgcggaactggactccccccctagcaagaagaaacggctcgggttctttcaaacatatgataccgagtacctgaaggtaggattcattatttgccctggtagcaaagaaagctctcctcgcccacaatgcgttatctgtggagagattctgagttctgagaatatgaagccagccaatctaagtcaccacctcaaaacaaaacattcggaactcgagaataaaccagtggacttctttgagcagaagtcgctggagatggaatgccaaaacagcagcctcaaaaaatgcctgcttgtcgagaaatctctcgttaaggcctcctatcttattgcttttcagaccgcagcatctaaaaagcctttcagtatagctgaagaactaattaaaccgtacctcgtcgagatgtgctcagaggtcctcggaagcagcgcaggcgacaagatgaaaacaatacctttgtcaaacgtgacaatccagcacagaattgatgagctgtcagctgatatcgaggaccagctcatccagaaggttcgcgaaagcaaatggttcgctctccagatcgacgaatcttccgagatcagcaatattaccttgttactttgctacatacgcttcattgactacgattgtagggatgtgaaggaggaattgttgttttgcattgaaatgccaacacaaatcactggcttcgaaatctttgagctgattaataaatatattgatagcaagtctttaaactggaagcattgtgtggggctgtgcactgatggcgcagcttctatgacgggtcgctactcaggcctgaaggctaagatccaggaagtcgccatgaacaccgctgcatttactcattgctttatacatagagagcgactagttgcggaaaagttgtccccatgtctccacaagatactgctccagagcgcacaaattctgtcatttatcaagtctaatgcactgaattctcgcatgctcactattctctgtgaagagatgggaagtgagcatgtgtctttacctttacatgctgaagtgagatggattagcaggggacgaatgctgaagcgcctttttgaactacgacacgagatcgaaatcttcctgtcacagaagcattcagatttggcaaaatatttccatgatgaggaatgggtgggaaagctggcatacctgagtgatatcttcagccttattaacgagcttaacctgtcactgcagggtacattgaccactttctttaacctgtgcaataagatcgatgttttcaagcgcaagctgaaaatgtggctcaagcgtacccaggaaaacgattacgatatgtttccaagttttagcgagttctccaactccagtggtctgaatatgacagacatcacacggattatcttcgagcatttggaaggactgtcccaggtcttttcagactgttttccacccgagcaggatctcagaagtggaaacttgtggattattcacccattcatgaatcatcagaacaataatctgacggattttgaggaggaaaaactgacagaactgagtagcgatcttggccttcaggccctgttcaagagcgtaagcgtcacccagttctggattaacgcaaagaccagttatcctgaactgcacgagagggcaatgaaattcctgttgcccttcagcaccgtgtacctgtgtgacgcagcgtttagcgccctcacggaatctaagcagaaaaatctgctagggagtgggccagcgttgaggttggccgttacatcgttaatacccagaatagaaaaactggttaaggaaaaagaatag

SEQ ID NO: 25990 - DNA, 513 bp, Artificial Sequence
  Description of Artificial Sequence: Synthetic coding sequence
atgaaggaaccattggatggagagtgtggaaaggcagtggtgccacagcaggagcttttagacaagataaaggaagagcctgataacgctcaagagtacggatgcgtacagcagcctaaaactcaagagagtaaactgaaaatcggaggcgtgtccagcgtgaacgagcggccaatagcacagcagctgaatcccggattccagctgtcgttcgccagttctggcccttctgttttgctgccatctgttcccgctgtagctattaaagtgttctgctccggctgcaagaagatgctctacaaaggccaaaccgcctatcacaaaactggaagcacccagctgttttgttcaacaaggtgtataactaggcatagtagtcctgcttgcctcccccctcctccaaaaaagacctgcacaaattgctccaaatacaagattttgaacatcccattttatttcacattcttcctggtgtgcattttgttttcctctaacattctgctcatactctag

SEQ ID NO: 25991 - DNA, 2172 bp, Artificial Sequence
  Description of Artificial Sequence: Synthetic coding sequence
atgaaggaacccctggatggagaatgcgggaaggccgttgtacctcagcaggaactgctcgataaaattaaagaggaacctgataatgctcaggagtacggatgtgtgcagcagcctaagacccaggaaagcaaactgaaaattggaggcgtgagcagcgtgaatgagagaccaattgctcagcagctcaatccagggttccaattgagtttcgcgtcctcaggccctagtgtgcttctgccgtctgtgcccgcagtcgccatcaaagtgttttgcagcggatgcaagaagatgttgtataagggacagacggcctatcataagacagggtctacgcaacttttttgcagtaccaggtgtatcaccaggcattcaagtccggcatgtttacctccccctcctaaaaagacatgcaccaactgctcaaaagacattcttaacccaaaagacgtcataaccaccaggttcgaaaattcctaccccagcaaagatttctgctcacagagctgtctgagctcttatgagctcaagaagaagccggttgtgaccatatacaccaagtcaatctccaccaagtgcagcatgtgtcagaaaaacgccgacacccggtttgaggttaaatatcagaatgtggtacacggactgtgcagcgacgcctgcttcagcaagttccatagcaccaacaacctgacaatgaactgttgcgagaattgtggatcttattgctattcatcatccggtccttgccaatcacagaaagtcttctcctcgacgtcagtcacagcttataaacagaatagtgcgcagattcctccttacgctctgggaaagtctctgaggccctctgctgaaatgatagagactacaaatgacagcggtaaaactgaactcttctgctcaatcaattgtcttagcgcatatagggtgaagactgtgacatcttctggagtgcaagttagttgccatagttgcaagacgtcagccatcccacagtatcaccttgccatgagtaacggaactatttattcattctgtagtagcagttgcgtggtcgcctttcagaatgtgttcagcaagcccaagggaacaaactcctctgccgttcctctttcacagggacaggttgtggtgtcccccccatcctcccgttccgctgtttcaattggtggaggcaatacaagcgccgtatcaccgtccagcatccgcggtagcgccgctgccagtctccaaccactcgcggagcagtcgcaacaggtggcactgacacacacggttgtcaaactgaagtgccagcactgcaatcatctattcgctaccaaaccggaactcttgttctataaggggaaaatgtttctgttttgcggaaagaattgctccgatgaatacaaaaaaaagaataaagtcgtggcaatgtgcgattactgcaaactccagaagatcattaaggagacagtgcggttctcaggcgtcgacaagcccttctgctctgaagtatgcaaatttctctctgctcgcgattttggtgaacgctggggtaattactgcaagatgtgtagttattgttcacaaactagccctaatcttgtcgaaaatcgtctggaaggtaagctggaggaattttgctgcgaggactgcatgtccaaatttaccgtgctcttttatcaaatggctaagtgtgatggatgcaagcgtcagggtaagctgtcggagtccatcaagtggaggggaaatattaagcatttctgcaatttattctgtgtgctggagttctgccatcaacaaatcatgaatgattgtctgccacagaacaaggttaacatcagcaaagcgaaaaccgcggtcaccgaactgccctcggcaaggaccgatactacaccagtgattacctctgtgatgtccctggccaagattccagcaacccttagcaccggtaacacgaactctgtgctgaaaggggctgttacgaaagaggccgctaaaattatccaagatgaatctacacaggaggatgccatgaagtttccttccagccagtcctctcagccttccaggctgctaaaaaacaaaggtatttcctgtaagcctgttactcagacgaaggccactagctgtaaaccgcacacacagcataaagaatgtcagactgagtgtcctgtgcgggctgtttgttag

SEQ ID NO: 25992 - DNA, 627 bp, Artificial Sequence
  Description of Artificial Sequence: Synthetic coding sequence
atgaaggaaccactggacggcgaatgtggcaaagctgtcgtaccccaacaagaacttcttgataagataaaggaagaacccgacaatgcacaggagtacggttgtgttcaacaacctaagacacaggagtctaaactcaagatagggggtgttagctctgtcaacgaaaggcccatcgcccagcagctcaatcctgggtttcagttaagcttcgcgagctcaggcccaagcgtcttgctgcctagtgtccccgcagtggcaattaaagttttttgcagtgggtgcaagaagatgctttacaagggtcaaaccgcctatcataagacaggcagcactcagctcttttgctcaaccaggtgcataacccgccattcttcacccgcttgcttgccacctcctccaaagaagacttgtaccaattgctctaaggacatacttaacccaaaggacgtgattacgacccggtttgaaaacagctatccttcaaaagatttctgttcccaaagctgtctgtcttcttacgagcttaaaaaaaagccagtagttaccatctacacaaagagcataagcacgaagtgcagtatgtgtcagaaaaacgcagacactcgcttcgaagtgaagtattag

SEQ ID NO: 25993 - DNA, 1689 bp, Artificial Sequence
  Description of Artificial Sequence: Synthetic coding sequence
atgagtcgggtacacgggatgcaccccaaggagactacccgacaactcagccttgcagtgaaagatggactgattgtagaaaccctcaccgtgggatgtaagggatccaaggccggtatcgaacaggagggttactggcttccgggtgatgagatcgattgggagactgaaaaccacgactggtattgctttgagtgccacttgccgggagaagtgttaatatgtgacctatgcttccgggtttatcactccaaatgtctttccgacgaattcaggctgagagattcgagctccccatggcagtgcccagtatgtcggtccataaagaagaagaatactaacaagcaggagatggggacctacctcagattcattgtgtcaagaatgaaagagagagccatcgacctaaataagaaggggaaagataataaacatccaatgtacagaagactggttcactccgctgttgacgtgccaaccatccaagagaaggttaatgaagggaagtatcggtcttatgaggagttcaaggcagacgcacagctgcttcttcacaataccgtaattttctatggcgctgattctgaacaggccgacatcgccaggatgctctacaaagatacctgccatgaactagatgaactgcaactgtgtaagaactgtttttacctgagtaatgccagaccagacaactggttctgctacccgtgcattcctaaccacgaattagtgtgggctaaaatgaagggctttggcttctggccggctaaggtgatgcagaaagaggacaaccaagttgacgtccgtttcttcgggcaccaccatcagcgggcttggatcccttccgaaaacatccaggacatcactgtaaatatccatagactacatgtcaagcggtcaatgggatggaaaaaggcctgtgacgaattggaactccatcaacgcttcttgcgcgagggcaggttctggaaatcaaaaaatgaagatcgcggtgaggaagaggctgagagttcaataagcagcacctccaatgaacagttaaaggtgacgcaagaacccagggccaaaaaggggagaagaaatcagtcagtcgaacctaagaaagaggaacctgaacccgaaacagaagccgtaagctcaagtcaggagatccccacaatgcctcagcctatcgaaaaggtttccgtgagtacacagacaaagaaactttctgcctcctccccgagaatgctgcataggtctacccagaccacaaacgatggggtgtgtcagtctatgtgtcatgataagtatacaaagatcttcaatgacttcaaagacagaatgaaatccgatcacaagcgagaaaccgagagagtggtccgagaggcgttagagaagctgagatccgaaatggaagaggagaagaggcaggctgtgaataaggcagtggccaacatgcagggagagatggaccgcaaatgcaaacaagtaaaggaaaagtgcaaggaggaatttgtggaggaaatcaaaaagcttgccacacagcataagcagttaattagccagaccaagaagaagcagtggtgctataattgtgaggaggaagctatgtaccactgctgttggaacaccagttattgctcgatcaagtgccagcaggagcattggcacgctgagcataaaagaacctgtcgtcgcaaacggtag

SEQ ID NO: 25994 - DNA, 1758 bp, Artificial Sequence
  Description of Artificial Sequence: Synthetic coding sequence
atggtgatttttacgagtctgcacaggtacgtgattttcatctcctgtatcatagttataaactggtacatgagccgtgtgcacggtatgcatccaaaggagaccactcgacagctaagcctcgctgtgaaagacggtcttattgttgagactttgactgtagggtgcaagggatcaaaagcgggaatcgaacaggagggatactggttgcctggtgatgaaatcgattgggaaactgagaatcatgactggtattgtttcgagtgccaccttcccggagaggtgttgatttgtgacctgtgcttcagggtctatcacagcaaatgcttgtcagacgagtttcgtctgagggactcaagttccccatggcagtgccccgtctgtcggtccatcaaaaagaaaaatacgaataagcaggagatgggcacttacctcagattcatcgtttcccggatgaaggagcgagccatcgatttgaataaaaagggtaaggacaataagcatccaatgtatcgcaggctagtccactctgccgtcgacgtaccaaccatacaggagaaggtaaatgaggggaaataccgttcttatgaggagttcaaggccgatgcccagctgcttctccataatactgtgatcttttatggggctgattcggagcaggctgacattgcccgtatgctttataaggacacatgccacgaactggatgagctgcaattatgcaagaattgcttttacttgagcaacgccagacctgacaactggttctgttacccttgtatccctaaccatgaactggtctgggcaaaaatgaaggggtttggattttggccagcgaaggttatgcagaaggaggataatcaggttgatgtacggttcttcgggcatcatcatcagagagcttggataccctctgaaaatatccaggacataaccgttaacatccatcgcttgcatgttaagcggagtatgggctggaagaaggcttgtgatgaactcgaactccaccagagatttcttagagagggcagattctggaagagcaaaaacgaggataggggcgaggaagaggccgaatctagcatatcatctactagcaacgagcagctcaaagtgacacaagaaccacgggctaaaaagggacgcaggaatcagtctgtagaacctaagaaggaagaacctgagccagagacagaggccgtgtcctcctctcaagagattccaacaatgcctcagcccatcgaaaaagtaagcgtgagcacgcagactaagaagctgtctgcgtcatcaccacgaatgttacaccgaagcacccagacaaccaacgatggggtgtgtcagtctatgtgccatgacaagtacacaaaaattttcaatgacttcaaggaccggatgaagtcagatcataaacgggagaccgagagggtagttagggaggccctggagaaattaagaagcgaaatggaggaggagaagcgacaggcagtgaataaggctgtggccaacatgcagggcgagatggacaggaagtgtaagcaagtgaaagagaaatgcaaggaggagtttgtggaagagatcaagaagctggccacacaacacaagcaactgatatctcagaccaagaagaaacagtggtgctacaattgcgaagaagaggccatgtaccattgctgctggaacaccagttattgtagcatcaaatgccaacaggaacattggcatgctgagcataaacggacttgccgccgaaaacgctag

SEQ ID NO: 25995 - DNA, 1809 bp, Artificial Sequence
  Description of Artificial Sequence: Synthetic coding sequence
atggctcgtctgacaaaacgcagacaagctgacaccaaagccatccaacatttgtgggcagccatcgagattattaggaatcagaagcagatcgcaaatatcgatagaattactaaatacatgtcgcgggttcacgggatgcatcccaaagagacaactaggcagctttctctggcagtgaaagatgggctcatcgttgagacactgacggtaggctgcaaaggctcgaaggcaggaatcgaacaagagggatactggctgccaggagatgaaattgactgggagaccgagaaccatgattggtattgcttcgagtgccaccttcctggagaagtgctgatttgcgatctgtgctttagggtttaccactccaaatgtctgagcgacgaatttcgcctgagagactctagtagcccctggcagtgtccggtgtgtcgtagtatcaagaaaaagaacaccaacaagcaggagatggggacttacctccggtttatagtgtctcgcatgaaggaacgggctattgaccttaacaaaaaagggaaagacaataaacatcctatgtacaggagactggtccattcagcagtggatgtgccgaccatacaggaaaaagttaatgagggaaaataccgcagttacgaagagtttaaagccgatgcccagcttttactgcacaatacggtcattttttatggtgctgacagcgagcaggccgacatcgcccgtatgttgtataaagacacgtgccacgagcttgatgaactgcagttgtgcaagaattgtttctatctgtcaaatgccagacccgacaattggttttgctacccctgcattcctaatcatgagctggtgtgggctaaaatgaagggcttcggattttggccggctaaggtcatgcagaaggaagataaccaggttgacgtgcgtttctttggacaccatcatcaaagagcctggatcccaagcgagaatattcaggacatcaccgtgaatatccatcgccttcatgtcaagcgcagcatggggtggaaaaaagcttgtgacgaactcgagctgcaccagaggtttttgcgcgagggaagattttggaaaagtaagaacgaggacaggggcgaggaggaggctgaaagctccattagcagcacatcgaatgagcaacttaaggttacacaggagccaagagctaagaaaggtcgacggaatcagtccgtggagccaaaaaaagaggagccagaacccgaaaccgaggccgtctctagttctcaggagatcccaaccatgcctcagcctatagaaaaggtctccgtctccacgcaaacaaagaaactctccgctagtagcccaagaatgctgcaccgttccacccagacaaccaacgacggcgtgtgccagtctatgtgtcacgacaagtacactaagatcttcaacgattttaaggaccggatgaagtctgaccataagcgtgaaaccgagcgggtggtgagagaggccttggagaaactccgctctgaaatggaggaggagaaaaggcaggcagttaataaggcagtcgctaacatgcagggggaaatggatcgcaagtgcaagcaggtgaaagaaaagtgcaaagaggagtttgtcgaggaaattaaaaagctagccacccaacataagcagctgatatcgcaaaccaaaaagaaacagtggtgctacaattgcgaggaagaggccatgtaccattgctgttggaacaccagctattgcagtatcaaatgtcaacaggagcactggcacgccgaacataaacggacctgccgaagaaagagatag

SEQ ID NO: 25996 - DNA, 1587 bp, Artificial Sequence
  Description of Artificial Sequence: Synthetic coding sequence
atgtctagggtccatggaatgcacccaaaagagaccacacgccagctgtctttagcagtgaaggacggattgattgtggaaacattaaccgtgggctgcaaaggttctaaagcagggatcgagcaggagggctactggctgccgggtgatgagatcgattgggagactgagaatcatgattggtattgcttcgaatgtcatttaccaggtgaggtcttgatatgcgacctctgttttagagtgtatcacagtaaatgccttagtgatgagttccggttacgggatagttctagcccttggcaatgccccgtttgccggagtataaagaagaaaaataccaacaagcaggagatgggtacatacctcaggttcatcgttagcaggatgaaagagagggcaatagatctcaataaaaaaggcaaggacaacaagcacccgatgtacagaaggctggtgcattccgccgtcgatgtgcctacaatacaggaaaaggttaacgagggcaaataccggagctatgaggagtttaaggcggacgctcaactcttgctgcataacaccgttatattttatggcgctgacagcgaacaggccgacatcgccagaatgctgtataaggatacctgtcatgagttagacgagctgcaattatgtaaaaactgcttctacctcagcaacgccaggcccgataactggttttgttacccatgcatccctaaccatgagctggtgtgggccaagatgaaggggtttggattttggcccgctaaagtgatgcaaaaggaagataaccaggtcgacgttagattctttggtcatcaccaccaacgtgcatggatccccagtgaaaacatacaggatatcactgtcaacatccaccgcctccacgtgaagcgctcaatgggctggaagaaggcgtgtgatgagctggagctccaccagcgatttctgcgcgagggacggttttggaagtcaaagaacgaggatagaggtgaagaagaagctgaaagcagtatctcctctacctctaatgaacagttaaaggtgactcaggagcctcgggcaaagaaaggaagacggaatcagagtgtcgaacctaaaaaggaggaacctgaaccagaaacggaggctgtgtctagctctcaggaaatccccactatgccccaacccatcgagaaagtttctgtatccactcagacaaaaaagctttcagccagtagtccacgcatgctgcatagaagtacacagacaactaacgacggagtgtgtcaaagcatgtgccatgataaatataccaaaatatttaacgatttcaaggacagaatgaagagcgaccacaagagggagaccgaacgggtggtgcgggaggccctggaaaaacttcggtcggagatggaggaggagaaaaggcaggccgtgaacaaggcagtggcaaatatgcagggcgaaatggaccgaaagtgtaaacaagtgaaagagaagtgtaaggaggaattcgtggaagagatcaagaaactggccactcagcataaacagcttatctctcagacaaaaaagaaacagtgggtcaacactagtctgttttag

SEQ ID NO: 25997 - DNA, 1689 bp, Artificial Sequence
  Description of Artificial Sequence: Synthetic coding sequence
atgagtcgagtgcacggcatgcatcccaaggagactacccgccagctttccttggcagtgaaagacgggctgattgtggagactctgacggtgggttgtaaaggaagcaaagccggaattgagcaggagggatactggctccccggtgacgagatcgactgggagaccgagaatcatgactggtattgcttcgagtgccatctgcccggagaagtgctcatttgcgatctctgttttagggtgtatcactctaaatgtctgtctgatgaattcagattgagggactcttccagcccgtggcagtgtcctgtgtgtagatccattaaaaaaaaaaacaccaacaagcaggaaatggggacctacttgcggttcattgtgtcacgaatgaaggagcgggctatcgaccttaacaaaaaaggaaaagacaacaaacatcctatgtatcggaggctggtgcattccgccgtggatgtaccgaccatacaagagaaagttaatgagggtaagtaccgctcgtatgaggagttcaaggcggatgcccagctgctcctgcacaatactgtcattttttatggagcggatagcgaacaggccgacatcgccagaatgctgtacaaagatacctgtcacgagctggatgagctacagctatgtaagaattgtttctatttaagcaacgctaggccagacaactggttctgttatccttgtatccccaaccacgagctggtctgggcaaagatgaaagggttcggcttctggcctgccaaggtgatgcagaaagaagacaaccaagttgatgtgcgatttttcgggcaccatcatcagagggcttggattccaagcgagaacatccaggatattacagtgaatatccatcgcctccacgtcaagagatcaatggggtggaagaaggcctgcgacgagctcgagctgcatcagagattcctgagagaggggcgtttctggaaaagtaaaaacgaggaccgcggagaagaggaagctgagtccagtatctctagcacttccaatgaacagctgaaagtaacccaggagccccgtgctaagaaagggaggcggaaccagtcagtagagcctaaaaaagaggaaccggagcctgagaccgaggcagtgagttcttcccaggagatacccactatgccccagcctatcgaaaaagtttctgtcagcacacagacaaaaaaattatcagcatcctctcccaggatgctgcacaggtctacccagactaccaatgatggtgtgtgtcagtctatgtgccacgacaaatacacgaaaatcttcaatgattttaaggatcggatgaaatccgatcacaagcgggagacggaaagagtggttagggaagcgctggagaagctgcgctccgaaatggaggaggagaaaagacaggcagtcaataaggcagtcgcgaacatgcagggcgagatggataggaaatgcaaacaggtgaaagaaaaatgcaaagaagaatttgttgaagaaatcaaaaagttggcaacacaacacaagcaactaatctcccagacaaaaaaaaagcagtggtgctataactgtgaagaggaggccatgtatcactgttgctggaacacttcctactgtagtatcaagtgccagcaagaacattggcatgctgaacataaacggacatgtcgcaggaagagatag

SEQ ID NO: 25998 - DNA, 1527 bp, Artificial Sequence
  Description of Artificial Sequence: Synthetic coding sequence
atgtcccgcgtacacgggatgcaccccaaggaaaccactcgtcagctttccctggccgtgaaggacggactcattgtggaaaccctcactgttggctgcaaagggtccaaggccggaatagagcaggagggctattggctgcctggcgacgagatctcgataaaaaagaagaacacgaacaagcaagagatgggcacatatctgcgctttatcgtgagccggatgaaggaaagggccattgatctgaataagaaagggaaagacaataagcatccaatgtaccgaagactggtgcattccgcagtggacgtcccaaccatccaagagaaagtgaatgaagggaagtacaggtcctatgaggagttcaaagcggacgcgcagctcctgcttcataacactgtaattttctatggggcagattccgagcaggcagacatcgcaagaatgctttataaagacacatgtcatgagcttgacgagctacagttgtgtaagaattgcttctatctgtccaatgccaggccagacaattggttctgctacccgtgtattcctaaccacgaactggtgtgggctaagatgaagggctttggtttttggccggcaaaagtgatgcagaaggaggataatcaagtggatgttaggttttttggccatcaccaccagcgggcttggatcccatcagaaaatattcaggacatcacggtgaacatccatagattacacgtgaagagaagcatgggctggaagaaagcttgcgatgagctcgaactgcaccaaaggttccttagggaagggcgtttctggaagtccaagaatgaagatagaggcgaggaagaagctgaaagttctatctcttctacatcgaacgaacagctcaaggtgacccaagagcctcgagccaaaaaggggagacgcaaccagagcgtggagcctaagaaagaggagccggaacctgaaaccgaagccgtgtcttctagccaagagatcccaacaatgccccaaccaatcgaaaaggtgagtgtcagcacccagaccaagaagttgagcgcgagctcgccccgaatgctgcaccgatctacacagactactaatgatggagtgtgccagtctatgtgccatgataagtatacaaaaatctttaatgacttcaaggaccgaatgaagtcagatcataaaagggaaactgaacgggtggtcagggaggccctggaaaagctgcggtctgaaatggaagaggagaagcgacaagccgtaaacaaggcagtggcgaatatgcagggcgagatggacagaaagtgcaaacaggttaaagagaaatgcaaagaagaattcgttgaggagattaagaaactcgccacccagcacaagcaactgatctcccagacaaagaaaaagcaatggtgttataactgcgaagaggaggcaatgtatcattgttgttggaacacgtcttactgttccatcaaatgccagcaggagcactggcacgccgaacacaaacgaacctgtagaaggaaaaggtag

SEQ ID NO: 25999 - DNA, 1554 bp, Artificial Sequence
  Description of Artificial Sequence: Synthetic coding sequence
atggctcgcctcaccaagagacggcaggctgacactaaggcgattcagcacttgtgggcagccattgaaataataaggaatcagaaacagatcgctaatattgacagaattaccaaatacatgagtcgtgtgcacggcatgcatcctaaggagacaacccgacagctgtccctggccgtcaaagacggtctcattgtagaaaccctgacagttgggtgcaagggtagcaaagccggaatcgagcaagaaggttactggctccctggcgatgagatctcgatcaagaagaaaaacaccaacaagcaggagatgggcacctacctccgcttcattgtttcaagaatgaaggagaggaaagtgaacgaaggaaagtatcgcagttacgaagaattcaaggctgatgctcagctgctgctgcacaacaccgttatattttacggagctgattcagaacaggctgacattgccaggatgctgtacaaggatacctgccacgagctggacgagttgcaactctgcaagaattgcttctacctgtcgaatgcaagaccagacaattggttttgttacccgtgcattccgaaccacgagctggtgtgggccaagatgaagggatttggcttttggcccgcaaaggtgatgcagaaagaagataatcaggtcgatgttcgcttctttggacaccatcaccagcgggcatggatcccgtccgaaaacattcaggacatcacagttaatattcatcgtctgcacgtcaaaaggtctatgggatggaagaaagcgtgtgatgaactggagctccatcagaggtttctgcgggaaggcaggttttggaagtcaaaaaatgaagatcgtggtgaggaagaagctgaaagtagcataagctcaacatccaacgaacaacttaaggtcacacaggagccgagagctaagaagggacgccgaaatcagagcgtcgagccgaaaaaagaggagcccgagccagagacggaagctgtcagcagctcacaggaaatacccacaatgccccagccaattgaaaaggtgagcgttagtacccaaaccaaaaagctgtctgcctcgagccccagaatgctgcacaggagcactcagacgacaaacgacggagtttgccagtccatgtgccatgacaaatacacaaagatcttcaatgatttcaaagatcgtatgaaatcggatcataaacgggagactgagcgcgtagtcagggaggctctagagaagctcagaagcgagatggaggaggagaaacggcaggccgtcaataaggccgtggccaatatgcagggagaaatggaccgtaaatgtaaacaggtgaaggaaaagtgtaaagaggaattcgtggaggaaatcaaaaaactggccacacagcacaaacagctgatctcccagaccaagaaaaagcaatggtgttataattgtgaggaggaggccatgtaccattgttgttggaacaccagctactgctccatcaaatgccagcaagagcactggcacgcagaacataagcggacttgccgtagaaagcggtag

SEQ ID NO: 26000 - DNA, 1809 bp, Artificial Sequence
  Description of Artificial Sequence: Synthetic coding sequence
atggccagactgaccaaacgtaggcaggctgacactaaggcgattcagcatctctgggcggctattgagatcattagaaatcaaaagcagattgctaacatagaccgtataacaaagtacatgagccgcgttcacgggatgcatcccaaggaaaccacgcggcagttgtcacttgctgtgaaagacggccttatcgtggaaaccctcactgtgggctgcaaaggaagtaaagcaggaatcgaacaagaaggttattggttgccaggtgacgagatcgactgggagacggaaaaccatgactggtactgcttcgagtgccaccttcccggtgaagtcctgatctgcgatctgtgcttcagggtctaccactctaagtgcttgtctgacgagtttcgcctaagagatagctcttcaccctggcagtgtcctgtgtgtagatctattaaaaagaagaatacaaacaagcaggagatggggacatacctgcgctttatcgtcagccgtatgaaagagagggctatcgacctgaataagaagggcaaggacaacaagcatcctatgtatcgcaggctcgttcacagcgcagtggatgtccccacaatccaggagaaggtcaatgaagggaagtatcgatcgtacgaagaatttaaggccgacgctcagctactcctgcacaacaccgttatcttctatggagccgactcagaacaggccgacatagcacggatgctttacaaggacacctgtcatgagctggatgaactgcaattatgcaagaattgcttctacctctcaaacgcacggcctgacaattggttttgttatccttgcatcccgaaccatgaactagtttgggcaaagatgaaaggatttggtttctggcctgccaaggtcatgcaaaaggaggataatcaggttgacgtgaggttttttgggcatcaccatcaaagagcatggattccgtcagaaaatattcaggacatcacagtgaacatacatcggctccacgttaagcgatctatgggctggaaaaaggcatgcgacgagctggaattgcatcagcggttcttgagagaagggagattttggaaatcaaagaatgaagaccggggtgaagaggaggctgagagctcaatttcctcaacatcgaatgagcagcttaaggtaacacaagaacccagggccaaaaaagggaggcgcaatcaaagtgtggagccaaagaaggaagaaccagagcctgaaacagaggccgtgtcctcatcacaggaaatcccgactatgcctcagcctatcgagaaggtctcagttagtacccagaccaagaaactttccgcttctagcccgcgaatgctccatcggagcactcagactaccaatgacggcgtctgccagagcatgtgtcacgacaaatataccaaaatctttaacgacttcaaggaccggatgaagtctgatcacaagagagagactgagcgagtggtgagagaggccttggagaagctgagatccgaaatggaggaggagaaacggcaagccgttaataaggcagttgccaatatgcaaggagagatggacagaaagtgcaagcaggtgaaggaaaagtgcaaagaagagttcgtggaagagattaaaaagctggctacacagcataaacagcttatttctcagacgaaaaaaaaacagtggtgttacaattgcgaagaagaagctatgtatcattgctgttggaacactagttactgctctatcaagtgtcagcaggagcactggcatgccgagcacaaacgcacttgtaggagaaagcggtag

SEQ ID NO: 26001 - DNA, 1569 bp, Artificial Sequence
  Description of Artificial Sequence: Synthetic coding sequence
atggccaggctgactaagcgcagacaggccgacaccaaggcgatacagcacttgtgggctgctattgagatcatccgcaatcagaaacaaattgccaatatcgaccgaatcaccaagtatatgtccagagtgcatggaatgcatccgaaggaaacaactcggcagctgagcttggcagttaaagacggactaatagttgaaaccctgaccgtagggtgcaaggggtcaaaggccggaatagagcaggaaggctattggctgcccggagacgagattagtatcaagaagaaaaacaccaacaagcaggaaatggggacctatctcagattcatcgtctcccgaatgaaggaacgcgctatcgatttgaataagaaaggaaaggataacaaacaccccatgtacaggcgcctggttcattctgccgtggatgtacctactatccaagagaaagtgaacgaggggaaatacagatcatatgaagagttcaaggccgatgctcagcttctcttgcacaacactgtgatattttatggggcagattctgagcaggcagatatagctagaatgttgtacaaggacacctgtcatgagatacctaaccacgaactagtgtgggccaagatgaaagggttcgggttctggcctgccaaggttatgcagaaggaggacaatcaggtggacgtcagattcttcgggcaccaccaccaacgtgcttggatcccaagcgagaatatacaggacattaccgtgaacattcaccggcttcatgtcaagcggagcatggggtggaaaaaggcttgcgatgagctggagctgcatcagagatttcttcgggaagggaggttctggaaaagtaagaatgaagaccggggagaggaggaagctgagtcctcaatttcaagcactagcaatgagcagctcaaagttactcaggagccaagagccaaaaaggggaggagaaaccaaagcgtggaacccaaaaaggaggagcccgagcctgagacagaagctgtgtctagctcccaggaaatccctaccatgccgcagccaattgagaaagtctcagtatcaacccaaacaaaaaagctgagcgctagctccccaagaatgttgcacagatccactcagactaccaatgacggggtgtgccaaagtatgtgccatgacaagtacacaaagatttttaacgatttcaaggacaggatgaaatctgaccacaaacgcgagaccgaaagggtggtgcgcgaggccttggaaaagctgaggagcgaaatggaagaagagaagcgacaggcagtcaacaaggcggtcgctaacatgcagggcgagatggataggaaatgtaagcaggtgaaggagaagtgcaaagaagaattcgttgaagagattaaaaagttggccacacagcacaagcaattgatttcacagacaaagaagaaacagtggtgctacaactgcgaggaggaagcaatgtaccactgctgctggaacacttcatattgcagcattaaatgccagcaggagcactggcacgcagaacacaaacgaacatgtaggcgcaagcgctag

SEQ ID NO: 26002 - DNA, 1704 bp, Artificial Sequence
  Description of Artificial Sequence: Synthetic coding sequence
atggccaggctgacaaaacggaggcaagctgatacaaaggccattcagcacctgtgggctgccattgagattataaggaatcagaaacaaatcgcgaacatcgataggatcacaaagtatatgtctcgcgtgcatggcatgcaccccaaagagacaacgcggcagttgagcctagcggtgaaagacggtctgatcgtcgaaaccctgacagtaggctgcaagggttcgaaggcgggaattgaacaggaaggctactggctccctggggacgagattgattgggaaacggaaaaccacgactggtactgcttcgaatgccatctgccaggggaggtgctgatctgtgacctgtgcttccgtgtgtaccactcaaagtgcctaagcgatgaattccgattgcgcgactcttcttcaccatggcagtgccctgtctgccgttctataaaaaaaaagaatactaacaaacaggaaatgggtacttatttgcggttcatagtctcccgtatgaaagagagggcaatcgacctgaacaagaagggtaaagacaacaagcaccccatgtatcgcaggcttgtgcatagcgccgtggacgtacccacaatacaagagaaggtcaatgagggcaagtacaggagctacgaggagttcaaagccgacgctcaacttctgttgcacaatactgtgatattctacggagatagcgaacaggcagacatagcaagaatgctgtataaagacacatgccacgagctggatgaattacagctatgtaagaactgtttttatctcagcaatgcccgacccgacaactggttttgttatccttgcattcccaaccacgagcttgtttgggcgaaaatgaaggggtttggcttttggcccgctaaagtgatgcagaaggaagataaccaggttgacgtccggttctttggacaccaccatcagagagcctggattccaagcgaaaacatccaggacataacagttaatatccaccggctgcacgtcaaacggtctatgggctggaagaaggcttgcgacgagttggagcttcaccagcgctttctgcgtgaaggccgtttctggaaatctaagaatgaggatagaggagaagaggaagcagagagctctattagctctacctccaacgagcagcttaaagtgacacaagagccacgagcgaaaaaaggtaggcgcaaccagtcagtcgagcccaagaaggaggaacccgagcccgaaacagaagcagtctcctcttctcaagagattccaactatgccacaaccgattgagaaagtctccgtttcgacccagacaaaaaagctctcagcgtccagcccaaggatgttgcaccggagtacccaaacaacgaacgacggggtctgtcagtcaatgtgtcacgataagtataccaagatttttaatgactttaaggacaggatgaagagcgatcataaacgcgagaccgaaagggtagtccgagaagcactggagaagctacgcagcgagatggaggaggagaaaagacaggctgtcaataaggccgtggccaacatgcaaggggagatggatagaaaatgcaaacaagtcaaagagaagtgcaaagaagaattcgtggaagagattaaaaagctcgcaacccagcataagcagctgatcagccagactaaaaagaagcaatgggtcaatacttcactgttctag

SEQ ID NO: 26003 - DNA, 1194 bp, Artificial Sequence
  Description of Artificial Sequence: Synthetic coding sequence
atgggcacttatctgaggtttattgtgtctaggatgaaagagcgggcaatagacctaaacaagaaaggcaaggataataagcaccctatgtaccgcaggcttgtgcacagcgccgtggacgtcccaaccattcaggagttggacgagttgcagctgtgtaaaaattgcttctacttgtctaatgcccgtcccgacaactggttctgctatccatgtatcccaaaccacgaactggtatgggccaagatgaaaggattcggattctggccagccaaagtgatgcaaaaagaggataaccaagtggatgtgcgatttttcgggcatcaccaccagcgcgcttggattccctccgagaacatccaggatattacagtcaacattcacaggctccatgttaagcggagcatggggtggaagaaggcgtgcgacgaactagagctgcaccagcggtttctgagggagggacggttctggaagtcgaaaaatgaggaccgtggggaggaagaagctgagagtagcatatcaagtacaagtaacgagcagctcaaagttacgcaagaacccagagccaagaaaggccgaagaaaccagtcagtcgaacccaagaaagaagaaccagagccagagaccgaggccgtttcctccagtcaagaaatccccacaatgccacagcccatcgagaaagtgtcagtgtccacccagacaaagaagctgtctgcctcctctccacgtatgctccaccgatctactcagaccacgaatgatggagtgtgccagtctatgtgtcacgacaagtacaccaaaatctttaatgacttcaaggataggatgaaatccgaccataaacgcgagaccgagagagttgttcgcgaagcactggaaaaactgcgctcggaaatggaagaggaaaaacggcaagccgtgaataaggcagttgcgaacatgcagggggaaatggatagaaagtgcaagcaggtcaaagagaaatgcaaagaggagtttgtcgaagagataaaaaaactcgctactcaacataaacagctgattagccaaaccaagaagaagcaatggtgctacaattgcgaggaagaggcaatgtaccattgctgctggaacacctcttactgtagtattaagtgccagcaagagcattggcatgctgagcacaaacgcacttgtcggagaaagcggtag

SEQ ID NO: 26004 - DNA, 1449 bp, Artificial Sequence
  Description of Artificial Sequence: Synthetic coding sequence
atgagcagggtgcacgggatgcatcctaaagaaacaacacgccagctgagtttggccgtcaaagatggcctcatcgtggagacacttacagttggttgcaagggcagcaaagcaggaatcgagcaggaaggttattggcttcccggagatgagatatctataaagaaaaagaatacaaataaacaggaaatgggtacctaccttcgatttatcgtatctcggatgaaggaaagggctatcgacctcaataaaaagggtaaggataataaacaccctatgtataggcgcctggtccacagcgcagtagacgtgccaaccatacaagagaaggtgaatgagggaaaatacagatcttatgaggaattcaaggctgatgcacagttacttctgcacaacacagtgattttttacggagccgacagcgagcaggcagacatcgcccgtatgctctacaaagatacttgtcatgagataccgaatcacgaactggtctgggccaagatgaagggattcggcttctggcccgctaaagtgatgcagaaagaagacaatcaggtggacgttagattcttcggtcatcatcaccagcgggcttggattccctccgaaaacatccaggacattacagttaatatccatagattacatgttaagaggtctatgggctggaagaaagcatgtgacgagctggagctccaccagcgattcttacgagaaggcaggttttggaagagcaagaatgaagatcgcggagaagaggaagccgagtcctccatcagctcgacgtctaatgagcagctgaaggttacccaggaaccacgagcaaaaaagggcaggcggaaccaatctgtcgaacccaagaaagaagagcctgagcctgagactgaggcagtgtcctccagccaagaaatccccacaatgccacagcctatcgaaaaggtgtcagtttctacccagacaaagaaactgagcgcctcgagtccacgcatgctgcatagaagcactcaaacaacaaacgacggcgtgtgccaatctatgtgtcatgataagtacactaagattttcaacgatttcaaagacagaatgaagagcgaccacaagcgcgagacggaaagagtggtcagggaggccttggagaagctcaggagcgagatggaggaggagaagaggcaagcagtgaataaagctgtggcgaacatgcaaggagagatggaccgcaaatgtaaacaggttaaagagaaatgcaaggaagagttcgtggaagagatcaaaaagcttgcaacccagcacaaacagttgataagtcaaacaaaaaagaagcagtggtgttacaactgcgaagaagaagctatgtaccactgctgctggaacacatcctattgtagtatcaagtgccagcaggagcattggcatgccgagcataaacggacatgccggagaaagaggtag

SEQ ID NO: 26005 - DNA, 3510 bp, Artificial Sequence
  Description of Artificial Sequence: Synthetic coding sequence
atggacatatcaacaagaagcaaggacccaggaagcgcagagcggacagcccagaaacggaagttcccctcaccgcctcactctagtaatggccactcgccccaagacacttcaacatcaccgatcaaaaaaaagaaaaaacctggtctccttaactctaataataaagaacagtccgaactccgccacgggccattctactacatgaagcagccattgacaacagaccctgtggacgtagttccacaggacgggagaaatgacttttactgttgggtctgtcacagagaaggtcaggttttatgttgcgagctatgccccagagtgtaccacgccaagtgtcttagactgaccagcgagcctgagggcgattggttctgccctgagtgtgagaagatcacagtggccgaatgcatcgagacacagtcaaaggccatgacaatgctgactatagaacagctctcctatctacttaagtttgccatccaaaaaatgaaacaaccagggactgatgccttccagaagcccgttcccttggagcagcacccagactatgccgagtatatcttccaccctatggatctgtgcacacttgagaaaaacgcaaaaaagaagatgtacggatgcacagaggctttcctggccgatgccaaatggatactgcataactgcatcatttacaacggcggaaaccacaagctgacccagatagccaaggtggtgatcaagatatgtgagcacgagatgaatgaaatcgaagtgtgtccagaatgctatcttgccgcatgccagaaacgcgataactggttttgtgagccttgtagcaatcctcaccccctagtgtgggccaaactgaagggattcccattttggccagcgaaggcactgagagacaaggacggccaggtggacgcacgatttttcgggcaacacgatcgcgcttgggtaccaatcaacaactgttatctgatgagtaaggaaattccctttagcgttaagaaaaccaaaagtatcttcaattctgctatgcaagagatggaggtgtacgtggagaatattcgtcgaaagtttggggtcttcaattactccccctttagaacaccttacaccccaaactcacaataccagatgctcctggatcccacaaaccctagcgccggtactgccaagatagacaaacaagaaaaggtgaaattgaacttcgacatgacggcctctccgaagattctgatgtccaagcccgttctcagcggaggcaccgggcgtaggataagtctcagcgacatgccaagatcaccaatgtcaaccaacagtagcgttcatacaggatcagacgtcgagcaggacgccgaaaagaaggcaactagctcccatttctctgcctccgaggagagtatggattttcttgataagtccaccgcttcaccagctagcacgaaaaccggccaagcagggtcgctgtctggtagtccaaaaccctttagccctcagctctctgcaccaattaccacaaaaacagacaagacctctactacgggttccatactgaatctgaatctggggcatcgctccaaagctgaaatggatctgaaagagctgagcgagtcagttcagcaacagtccacgcccgttccgttgatttcccccaaacggcaaattagatcccggttccagctgaatctggacaaaaccatcgagtcatgcaaggctcaactgggcattaacgagataagcgaagatgtgtatactgctgtggaacacagcgattcggaggacagcgagaaaagtgatagcagcgactctgagtacatctccgatgacgagcagaaatcaaaaaacgaacctgaggatacagaagacaaggagggttgccagatggacaaagagcccagcgcggtgaagaagaaacccaaacccacaaacccagtggagattaaggaggaattgaaaagcaccagccccgcatcagagaaggccgatccaggcgcagtgaaggataaggctagcccagagcctgagaaagacttttccgagaaggcaaagccctccccacaccccattaaggataaattgaaaggaaaggatgaaaccgactcacctacagtccaccttggactcgattcagatagtgaatccgaactggtgattgacctgggggaggatcattcaggcagggaaggcaggaagaataagaaagagcccaaggagccttctcccaaacaagatgtggtcggaaaaacgcccccaagcacaacagtgggcagtcacagccctcccgagacaccagtacttacccgaagcagtgctcagacctcagctgctggggctacggcgactacttccacctcatcgactgtgaccgtgaccgctcccgcacctgctgccacgggtagccccgtgaagaagcagagacctcttttgcctaaggagaccgcacctgcggtgcagcgcgtggtgtggaactcatctacagttcaacagaaggagatcacccagagcccttcgacatcgaccatcacactggtcacatccacccagtcttctccgctggtcactagttcaggcagcatgagtacactggtgtccagcgtcaacgccgatctccctatagctacagccagtgccgacgtcgccgctgatatagctaagtacacttccaaaatgatggacgcaattaaagggactatgaccgaaatctataacgacctgtcgaaaaatactacgggcagcacaatcgctgagattaggaggctccggatcgaaatcgagaagttacagtggcttcaccagcaggagctaagcgaaatgaaacacaacctggagctgaccatggccgaaatgaggcagagtctggaacaagagagagaccgtctgattgccgaagtgaagaagcagttagaactcgagaagcagcaggcggtggacgaaacaaagaagaagcagtggtgcgccaactgtaagaaagaggctatcttctattgctgttggaacacctcttactgcgactatccgtgtcaacaggcacattggcccgaacatatgaagtcgtgtacccagagtgccactgccccacaacaggaagcagatgccgaggtaaacaccgagacactgaacaagtcatctcaggggtcaagctccagcacccagtctgcacctagtgagacagcctcagcatcgaaggagaaggagacgtcggcagaaaaatcgaaggaatctggatcaactttggacctgtcaggaagcagggagacgccctcttcaatacttctgggtagtaatcaaggctcggtcagcaaaagatgtgacaagcagcccgcttacgccccaaccacaactgatcatcagccccatcccaactatccagcacagaaataccatagtaggtcaaacaagtccagttggtccagctcggacgagaagcgtggctccactcggtcggatcataatacctcaaccagcaccaagagcctcctcccaaaagaatcaaggctggacaccttctgggactag

SEQ ID NO: 26006 - DNA, 3561 bp, Artificial Sequence
  Description of Artificial Sequence: Synthetic coding sequence
atggacatcagtacacgatccaaggaccctggatctgcagagcgcactgctcagaagcgtaaattccccagcccccctcattctagtaatggacatagcccccaggatacctccacctctcccattaagaagaagaagaagcctgggttactcaatagtaataacaaggaacagtcggaacttagacacgggccattctattacatgaaacaacccctgaccacagaccccgttgatgtagtgccgcaggatggcaggaatgatttttattgctgggtgtgccaccgagaggggcaagttctttgttgcgaactctgtcccagggtgtatcacgcgaaatgcctgagactgacctctgaacccgaaggggattggttctgtcccgagtgtgaaaaaattacagttgccgagtgcatcgagacacaatccaaagcgatgaccatgctgacaatcgaacaactgtcatacctgttgaagttcgccatacaaaagatgaaacaacccggtactgatgcttttcagaagcccgtgccactggagcagcatccagattacgccgaatatatttttcatccaatggatttatgtaccctggaaaagaatgcgaaaaagaagatgtacggctgtacagaggcgtttctcgctgatgctaagtggattttacataattgcattatctataatggcggaaaccacaaacttactcagatcgccaaagtggttattaagatctgcgaacacgagatgaacgaaattgaagtctgccctgaatgttacttggccgcttgtcagaagcgggacaactggttttgtgaaccttgctccaaccctcaccctctggtttgggccaaactcaagggattcccattctggcccgcaaaggcccttagagataaggatggtcaagtggacgccagattcttcggccagcacgaccgcgcatgggtgccaattaacaattgctatctgatgtctaaggagatcccattctctgtgaagaaaaccaagtcaatcttcaacagtgctatgcaggagatggaagtttatgttgaaaacattcgcaggaagtttggcgtgttcaattatagcccctttcgcacaccctacacccctaattctcagtaccagatgcttctcgacccgacaaacccgtctgcgggtactgccaagattgacaaacaagagaaagtcaaactaaatttcgatatgactgctagtcccaaaatcctgatgtccaagcctgtcctgagcgggggtacaggcaggaggatctctctcagcgacatgcccagatcaccaatgtctaccaacagcagcgtgcacacggggtcagatgtggaacaggatgccgaaaaaaaggcaactagtagtcatttcagcgcctcagaagagtccatggacttcctggacaagtctaccgcttcgccagcttccactaaaaccggacaggcaggcagtctcagcggctcccccaagccattttcacctcaattatctgcgccaataaccactaaaactgacaagacgagcaccacgggctctatcctaaatcttaatctggacagatccaaggccgaaatggatttgaaagaattgagcgaatccgttcagcagcaaagcacacctgtcccactgatttcccccaagcgccaaatccgatctcgattccagctgaatctcgacaagactatcgagagttgtaaagcacagctgggcatcaatgaaatctcagaagatgtgtataccgccgtggagcacagcgactccgaggactccgagaaatctgactctagtgacagtgagtacatatcagatgatgaacaaaaatcgaaaaacgaaccagaagacacagaagacaaggaggggtgccagatggataaggagccatctgcagtaaagaaaaagccgaagccaaccaaccccgttgagatcaaagaggagttgaagagcacgtcacccgcaagcgagaaagccgatcctggagctgtgaaagacaaagccagccccgagcccgagaaggatttcagcgagaaggcaaagccttctcctcatcctataaaagataagctgaaaggcaaggatgaaaccgactctcccacggttcatctgggactggattcggactctgaatctgagctcgttatcgatcttggagaggaccacagtggcagggaggggaggaagaacaagaaggagcctaaagagccatcccccaagcaagatgttgtgggcaagacgcctccctctacgactgtgggaagccactcccccccagaaacgccagtgcttactcggtcctcagcccaaacttcagctgcaggtgctaccgcgactacaagcacttcctccactgtgacggtgaccgcccctgcccctgccgcaacaggcagtcccgtcaaaaaacagcgccctcttctgcccaaggaaaccgctccagccgtacagcgggttgtttggaactccagcagcaagttccagacaagctcccagaaatggcacatgcagaagatgcagaggcagcaacagcagcagcagcagcagaatcaacagcagcagcctcagagcagtcagggtacaagataccaaacaaggcaggctgtgaaggcggtccagcagaaggagattacccagtcacccagtacgtctacaattacacttgtcacttctacgcagtcaagcccccttgtcacaagttccggttcgatgtcaactctggtgtcatcagtaaacgccgacctccctatcgctacagccagtgccgacgtcgccgctgacattgcaaagtacactagtaagatgatggatgcaattaaggggacaatgaccgaaatttataacgacctctctaaaaatactactggaagtacgatagcagagattcgccgtctgcgcatcgaaatcgagaagcttcaatggctccaccagcaggaattgagtgaaatgaagcacaacctggaactgactatggccgagatgaggcagtcactagaacaggaaagagaccgcctgatagctgaagtaaagaaacagcttgaactggagaaacagcaggcagtggatgaaactaagaagaagcagtggtgtgcaaattgtaagaaagaggcaatattttactgctgctggaacacctcttattgcgactacccatgtcagcaagctcattggcccgagcacatgaagtcctgcacccaaagcgcgacagccccacagcaggaagccgacgcagaggtgaacacagagacgttgaacaagtcctcccaaggcagtagttctagcacccagtccgcacctagcgagacggccagcgccagtaaagaaaaagagacctctgcagaaaagagcaaagaatcgggttctacccttgaccttagcggctccagggaaactccatcaagcatcctcctgggatcaaaccaggggtctgatcacagtaggtccaacaagagctcttggagctccagtgatgaaaagagaggctcaacacgcagcgatcacaacacatccacttctactaaatcgctgcttcctaaggagtcgcgtttagacaccttttgggactag

SEQ ID NO: 26007 - DNA, 3483 bp, Artificial Sequence
  Description of Artificial Sequence: Synthetic coding sequence
atgcacccacagagcttggccgaggaggagattaaaacggaacaagaggtggtggaaggtatggacatctccacccggtccaaagacccaggtagcgccgaacgcacggctcagaagcgtaaattcccaagccccccacactcatctaacggacattctccacaagacacaagcacgtccccaatcaagaagaaaaaaaagcctgggctcctgaatagcaataacaaggagcaatcagaactgcgccacggcccattctactatatgaaacaaccgctgacgaccgatcctgtggacgtggtaccgcaagacggtaggaacgacttctactgctgggtatgtcatcgagagggtcaagtcctgtgttgtgaactgtgtccaagggtttaccacgctaaatgtctcagactgacatcagagcccgaaggcgactggttctgtccagaatgcgagaaaataaccgtcgccgaatgtatcgaaacccaatctaaagcaatgaccatgctgaccattgaacagctgtcctatttacttaaattcgccatacagaaaatgaaacagcccggtaccgacgcctttcagaagcccgtgccgctggaacagcacccagattacgcagaatacattttccaccctatggatctgtgcaccctggagaagaacgcaaaaaagaaaatgtatggttgtacggaagcatttcttgctgatgcgaagtggattctccataattgtattatatataatggcggaaaccataagttaacgcagatcgctaaggtcgtaattaaaatttgcgagcatgaaatgaatgaaatagaggtgtgcccagaatgctacctggctgcatgtcagaagagagataattggttctgcgaaccttgttcaaaccctcacccattggtgtgggcaaagctgaagggattccccttctggccagcaaaggcgctccgggacaaagacggccaggtcgacgccaggtttttcgggcagcatgaccgcgcttgggtcccaatcaataattgctacctcatgtctaaggagattccattctcagttaagaaaacaaagagcatctttaacagcgcaatgcaggaaatggaagtctatgtggagaatattagacggaagttcggcgtgttcaattactcacccttccgaactccttatacccccaatagtcagtatcagatgctgctagaccctaccaacccgagtgctgggactgccaagatcgataagcaggaaaaagttaagttgaattttgatatgaccgcgagcccaaagatcctgatgagtaagcccgtcctgtcaggcggtacaggcagacgcataagtctgagcgatatgccaagaagtcccatgagtactaatagctcggtgcacaccggctccgacgttgagcaggatgctgagaagaaagcaacatcgagccactttagcgctagtgaggagagcatggactttctggacaagagtactgccagccctgctagcaccaagacaggccaggccggatcactgtcaggcagccccaaacccttcagtccgcagctatccgcaccgataaccaccaaaactgataaaacaagtacaacgggaagcattttgaatttgaaccttgaccggtcaaaggccgaaatggaccttaaagaactgagcgagagcgtacaacaacagagcaccccagtccccctgatcagtccgaaaaggcagatcaggtctcggttccagcttaatttggacaaaactattgaatcttgtaaagcccaactggggatcaatgagatatctgaggacgtgtacactgctgtggagcatagtgattccgaagattccgaaaagtcagattcttctgacagcgagtacatctctgatgacgaacagaaatcaaagaatgaaccagaagacacagaagataaagagggttgtcagatggacaaagaacccagcgctgtgaaaaaaaaacccaaacctaccaaccctgttgaaatcaaagaggagcttaagtctacatctccagcatctgaaaaggccgacccaggcgctgtcaaggacaaagcttcccccgaaccagagaaggacttttctgaaaaagccaaaccttctccccatccaataaaggacaagctcaagggcaaagacgaaaccgattcaccaacggtgcacctgggactggattcagactccgaaagtgagctggtgattgacctaggggaggatcattcggggagggaggggaggaaaaataaaaaggaaccaaaagaacctagccctaagcaggatgtggtgggaaagaccccaccctctaccacagtgggttcacactctcctccagagacacccgtgcttacgaggtcatccgcccagactagtgcggctggagccaccgccaccacctccacgtcatctaccgtcactgtcaccgctcccgcacctgccgctacaggcagccccgttaaaaagcaacgtcctctgttgccgaaggagactgctcctgctgtgcagagagtggtgtggaactcctcaaccgttcaacagaaggagatcactcagtcaccatctacatctaccatcacgctggtgacctcaacccaatcctctcctcttgtaactagttctggctccatgtccactctggtgtcttcggtgaacgctgatttgcctattgctacagcttccgcggacgttgcagccgatattgccaaatatacgtctaaaatgatggatgcaataaaggggactatgactgagatctataacgacctctctaagaatactaccggctccaccattgcagaaattcggaggttgaggattgaaattgaaaaactacagtggttgcatcaacaggaactgtctgaaatgaagcacaacctggaattaaccatggccgagatgagacagtctcttgaacaggagagggacagacttatcgctgaggttaaaaaacaacttgagcttgagaaacagcaggctgtggatgagaccaaaaagaagcaatggtgcgcgaattgtaagaaagaagctatcttctactgttgttggaacaccagctattgcgactatccttgtcagcaggcccactggcccgaacatatgaagtcctgtactcaaagcgccaccgctccccagcaggaggcagacgctgaagttaataccgaaaccctcaacaaaagctcccaggggtcaagtagcagcacccagagcgccccatccgagactgccagcgcatccaaagaaaaggagacgagcgcagagaaaagcaaggaatccggaagcacactggacctgagtgggagtcgtgagacccctagtagtatattgctcggttccaaccagggctctgaccactcccgatctaacaagtctagctggagttcctccgacgaaaagcgaggtagcacacgctctgatcacaatacaagtacaagtacgaaatccctgctacccaaggaatcccgcctggatactttttgggactag

SEQ ID NO: 26008 - DNA, 3645 bp, Artificial Sequence
  Description of Artificial Sequence: Synthetic coding sequence
atggacatctcaacccgctcaaaagatccaggcagcgctgaacgcaccgcccaaaaaaggaaattcccatccccaccccacagctccaatggccactccccccaagacacaagcacttctcccatcaagaagaaaaagaagcctgggctgttaaactcaaacaataaggagcagagcgaactcagacatggcccattttactatatgaaacagccactcacaacagacccagtcgatgtggtcccccaagacggcaggaatgacttttattgctgggtttgccatcgggaaggacaagtgctgtgttgcgagctgtgccccagagtttaccatgcaaagtgtcttcgtctcacctcggagcccgagggagactggttctgtcccgagtgtgagaagatcacggtcgcggaatgcattgaaacgcaatccaaggccatgacaatgttaaccatcgaacagctgtcatacttattgaagttcgccattcagaaaatgaagcagccagggactgatgccttccaaaaaccggtccctctggagcagcatccagattacgcggagtatatcttccaccccatggacctgtgcaccctagagaagaacgcaaagaagaaaatgtatggatgtactgaggctttcctggcagatgcaaaatggatcctacacaactgcattatctacaacggaggaaatcataagctgacccagatcgctaaggtcgtaattaaaatttgcgagcatgagatgaacgagatagaagtatgcccagaatgctatctggcggcatgtcagaaacgggacaattggttctgcgagccgtgttctaacccccatccgctggtatgggccaaactgaaagggttcccattctggccagccaaagccctgcgggacaaagatggccaggtcgatgctagatttttcggccaacatgatagagcttgggtacccataaacaattgctacctaatgagcaaagaaattccatttagtgtaaagaaaaccaagtcaattttcaattcagccatgcaggaaatggaggtttatgtggagaacattagacgcaagtttggggtgtttaattacagcccattccgcacaccctatacgcccaattcccagtatcaaatgcttctggatccgaccaacccatctgctggcacggctaagattgacaagcaggagaaagtgaagctgaactttgacatgacagcgtctcctaaaattctaatgagcaagcctgtgctatctggcggtaccggcaggcgaatctctcttagtgacatgccacggagcccaatgtctacgaatagttcagtgcatacgggcagcgacgtagagcaggatgctgagaagaaagcgacgagctcccacttttcggcgagcgaggagtccatggacttcttggataaatcaacagcgtctcctgcatcaacaaaaactggacaggccggaagtctgtccggaagccccaagcctttttcacctcagctgagcgccccaataactactaagaccgacaagacgtccacaaccggcagtatcctcaatctcaacctagataggtccaaagccgagatggatttgaaagaactaagcgaatctgtacaacagcagtctacccctgtaccactgatcagcccgaagcgtcagatcaggtctcggtttcagctgaacctggacaagactattgaatcttgtaaagcgcagctcggcatcaacgaaattagtgaggatgtgtacaccgccgtggagcatagcgatagtgaggacagtgagaaatccgactcctctgactctgagtatatcagcgatgacgagcagaaatctaaaaacgaaccggaagatactgaggacaaggagggttgtcaaatggacaaggagcctagcgccgtgaaaaagaaacccaagcctacaaacccagtagagatcaaggaggaacttaaatccacctcccctgcctccgaaaaggccgatccaggagccgttaaagacaaggcctctcccgaacccgagaaagatttctctgagaaggccaagccaagccctcatcccatcaaggacaaactgaagggaaaagatgagaccgattctccaaccgtacacctagggctcgactctgatagcgagagcgaacttgtgatcgaccttggagaggaccactccggccgtgagggtcgcaaaaacaagaaagagcccaaagagccctcgccaaagcaggatgtggtggggaaaacaccaccctccaccaccgttggtagccactctccacccgagaccccagtactgacgaggtcctctgcacagacctccgcggcaggggcaacagctaccacatccacttcaagcacagtgacggtaaccgcacctgctccagccgcaactggctcgcctgtcaagaagcagcgtccactgctcccaaaggagacagccccagccgtacagcgcgtggtgtggaatagctcaagcaagttccagaccagcagccagaagtggcacatgcagaaaatgcaaaggcaacagcaacagcagcaacagcaaaaccagcagcaacagccacagagttctcagggaactcgatatcagacccgccaggccgtcaaggccgtccagcagaaagaaatcacacagagtccaagtaccagtaccattactctggttacgtctacgcagagctcacccttggttacttcctcgggctccatgagcaccctcgtatctagtgtgaacgctgaccttcctatagcaacagcgtccgccgacgtagccgcagatattgctaaatatacttccaaaatgatggacgctataaagggaacaatgactgagatctacaacgacttgtcgaagaacaccaccgggagcacgattgcggagatccgaagacttcgcatcgaaattgagaaacttcaatggctacaccagcaggagctgagcgagatgaagcacaatctggaactcactatggctgaaatgcggcagtctttggagcaggaaagagatcgacttattgctgaggtgaagaagcagcttgaattggagaagcaacaagcggtggatgagacgaagaagaagcagtggtgcgcaaactgcaagaaagaagccatcttttactgctgttggaatacgagctattgtgattatccttgtcagcaggcccactggccagaacacatgaagtcatgtacccagagcgccaccgccccacagcaggaggctgatgccgaagtcaacactgagacactaaataagtcatcacaagggagcagctcttctactcaatcagcgccatcggagactgcaagcgcctctaaggaaaaggagactagtgcagaaaagagcaaggaatccggctctacactggacttgtccgggagccgcgagacaccctcatccatcttgttaggatctaatcaggggtcagtgagtaaacgctgcgataagcaacccgcatatgcgccaacgaccactgaccatcagccacatccaaattatccagcgcagaagtatcatagtaggtcaaacaaatcatcttggtccagctctgatgaaaagcgtggttccacaagatctgaccacaacacgtctacgagcactaagtccttgttacctaaggaatcaaggcttgacaccttttgggattag

SEQ ID NO: 26009 - DNA, 3408 bp, Artificial Sequence
  Description of Artificial Sequence: Synthetic coding sequence
atgcatcctcagtcgcttgcagaggaagaaatcaaaacggaacaggaggtggtggaagggatggatatcagcaccaggagcaaagacccaggttcagcagagcgcacggcccaaaagcggaagttcccatctccgccacactcttccaacgggcattccccccaggacaccagtacatctcccatcaaaaagaagaaaaagcccggactgctcaattcaaataacaaggaacaagatggaagaaatgacttctattgttgggtgtgccacagagaggggcaggtgctgtgttgtgagctgtgccccagagtgtaccatgctaagtgtttgcggctgacctccgaaccagagggagattggttttgtccagagtgcgaaaagatcacagtcgctgaatgcattgaaacccagtcaaaagccatgaccatgctcactattgaacagttatcctatcttttgaagtttgcaatacagaagatgaagcagcctggaacggacgcatttcagaaaccagtgccactagagcagcacccagattatgctgagtacattttccacccgatggatttatgcaccttggagaagaacgcaaagaaaaagatgtacggctgtacagaggcatttctcgccgatgcaaaatggatactgcacaattgtatcatatacaatggcggaaaccataagctgacccagatcgcgaaggtggtcataaagatctgtgaacacgaaatgaatgaaattgaagtgtgtcccgagtgttaccttgccgcttgccagaagagggataactggttctgtgaaccctgttccaaccctcaccctctcgtatgggccaagctcaagggtttcccattttggcccgctaaagctcttcgcgataaggatggccaagtagatgctcggttttttggacagcacgaccgcgcatgggtccccataaacaactgctatcttatgagcaaagaaatacctttcagcgtgaagaagactaagagcatcttcaattccgctatgcaagagatggaagtgtacgtggagaacattcgtcgcaagttcggcgtttttaattacagtccatttcggacaccgtatacgccaaactctcagtaccagatgctcctggacccgactaacccctcggctgggacagcaaagattgataagcaggagaaggtgaagcttaacttcgacatgactgcttcacctaagatcttaatgagtaagccagttctttctgggggtactggacggagaatctctctctctgacatgccacgatcaccaatgtccaccaattcctcggttcatactggctcagatgtggagcaggatgcggaaaaaaaggcgacaagctcacattttagtgccagcgaagaatccatggactttctggataagtccacggcatcacccgctagtacaaaaacaggtcaagcagggtctctgtccggctctcctaagccattttccccgcagttgagtgctcctatcaccacaaaaacggacaagactagcaccacggggtccatcttgaaccttaatctggataggtccaaagcagagatggatttaaaggaattgtctgagtcagtgcagcagcagagtacacccgtgcccctgatttcccctaagcggcagatcagatcacgattccaacttaatttggataagactatcgagtcctgcaaggctcagcttggcattaatgagatatccgaggatgtgtataccgccgtggaacactccgatagtgaagatagcgaaaagtcagactcatcagacagcgagtacattagcgacgacgagcagaagagtaagaacgaaccggaggataccgaagacaaagaaggttgtcagatggacaaggaaccaagtgccgtgaagaagaagccaaaaccaacaaacccagtggagatcaaagaagagctcaagtcaaccagccctgcctctgagaaggccgatccgggagctgtgaaagataaagcctcaccagaaccggaaaaggattttagcgagaaggccaagccctctccccaccccattaaggataagctgaaaggcaaggacgagaccgatagccccactgtccatcttggattggatagtgatagtgagtctgagctggtgatcgatttaggcgaggaccatagcggcagggagggacggaagaataaaaaggaaccaaaggaacccagtccaaagcaggacgtcgtgggcaagaccccaccgtcaactacagtcggtagtcattccccacctgagacaccagtgctcacaagatcatcagcacagacatcagccgctggagcaaccgcaactacctccacctcttccactgtaaccgtaacagcccctgcccctgcagcaaccggcagtccggtaaagaagcagagacccctgttgcccaaggagaccgcccctgcggtccagcgcgttgtctggaacagttccacagtccagcaaaaagaaataacccagagcccctccacaagcacaataacactcgtcacatcaactcagagttctcctttggtaacttcttccggttctatgtccactctggtctcatccgtcaacgctgatctccctattgccaccgcctcagcagatgtagccgcagacatcgccaaatatacatctaagatgatggacgcgatcaagggtaccatgacagaaatttataacgacctttcgaagaataccactggctcgaccatagccgagatcagaagactacgaatagagatcgagaaactccagtggctacaccaacaggagctgtctgaaatgaagcacaacctggaactgaccatggcggagatgaggcagagcttggagcaagaaagagacagactcatcgctgaggttaagaaacagctcgagcttgaaaagcagcaagcagttgatgaaacaaaaaagaaacagtggtgcgccaattgtaagaaggaggcaatattttactgttgctggaacacctcgtactgcgactatccgtgtcagcaggcccactggcctgaacacatgaagtcatgcacccaaagcgctacggcaccccagcaggaggcggatgccgaagtgaacaccgaaaccctgaataagtcttcacagggctccagctcctctacacagagcgcacctagcgagaccgcgtccgcgagtaaggaaaaggaaactagcgctgagaagtctaaggagtcaggatcaactttggatcttagtgggtcgagagagaccccctccagcatccttctgggatctaatcaggggagcgaccatagccgtagtaataaaagttcctggagctcctctgacgagaagcggggtagtacccggtccgatcacaatactagtacaagcacaaaatccctcctcccaaaggaatctcggcttgataccttttgggactag

SEQ ID NO: 26010 - DNA, 3411 bp, Artificial Sequence
  Description of Artificial Sequence: Synthetic coding sequence
atgcacccacagagtctcgccgaggaggaaataaagaccgaacaggaggtagtcgaaggcatggacatttccacacgctccaaagaccccggatcggccgagagaacggcacagaaaaggaagtttcctagtcccccacactcctccaatgggcactctccacaagatacatccacatctcccattaagaagaaaaagaagcccggactgctcaacagcaacaacaaggaacaggatggtagaaatgacttctactgctgggtgtgtcatagggaagggcaagtgctgtgctgtgaactgtgcccgagagtttaccacgcgaaatgtctgaggctgacatctgagcccgagggggactggttctgtcccgagtgcgaaaaaatcacagtcgccgagtgcattgagacgcagtctaaagcaatgaccatgctgaccatagaacagctgagctatctccttaagtttgccatacagaaaatgaaacagcccggaacagacgccttccagaagccagtcccacttgaacagcatccagattacgcagaatatattttccatcccatggacctgtgtaccctcgagaaaaacgccaagaaaaagatgtatggctgcacagaagcctttctggcagatgcaaagtggatactgcataattgtattatatataacgggggtaaccataagctcacacaaatcgccaaagtagtaattaagatctgtgagcacgagatgaatgaaatagaggtgtgccctgaatgttacctagccgcttgccaaaagagagacaattggttctgtgaaccatgctccaatccccatcctcttgtgtgggccaaattgaaaggatttcccttctggccggctaaggctctgcgggacaaagatgggcaggtcgatgctagattctttggccagcacgacagggcctgggtcccgattaacaactgctacttaatgagcaaagaaatcccattttcagtgaaaaaaactaaatctatttttaactctgcaatgcaggagatggaagtgtacgttgagaatatccgtcggaagtttggcgttttcaactatagcccattccgtactccatacactcctaattcacaataccagatgctgctggaccctaccaatccatctgccggaaccgctaaaattgacaaacaagagaaagtaaagctgaacttcgatatgacggcctctccaaaaatactcatgagtaaacccgtcttgtcgggcggaactggacggcgtatttccttgtcagatatgcccagaagccccatgagcaccaatagctccgtgcatactggctcagatgtggaacaggacgccgaaaaaaaggcaacgagctcacacttttctgcctcagaggagtccatggatttcctcgacaaatccactgccagccccgcatcaactaagacaggacaggctggatccctgagcggcagccctaaaccttttagccctcagttgagcgccccaattactaccaagacggacaaaaccagcacaaccggctccattctcaatttgaatctcgatagaagcaaagccgagatggatctgaaggaattatccgagtctgtgcagcaacaatcaacaccagtgccactgatttcccctaagcggcagatccgatcccggtttcagcttaatcttgataagacaatagagtcatgtaaagctcagctgggcatcaacgaaatttcagaagatgtttacacagctgtggaacattctgattccgaagactcggaaaaatccgactcttccgactcggaatacatctctgatgacgaacagaaaagcaaaaacgaacccgaggatacagaagataaggagggctgccagatggataaggagccttccgccgtaaagaaaaagccaaagcccactaatccagtcgagattaaggaggagctgaaatcgacaagccccgcttccgagaaggccgatcctggcgcagtgaaagacaaagctagcccagagccggagaaagacttttccgagaaggcaaaaccatcacctcatccaattaaagacaaacttaagggaaaagacgaaactgattctccgactgtgcatctgggactggattctgatagtgagtccgagcttgttattgatctcggggaagatcattctgggagggaaggcagaaaaaacaaaaaggaacccaaagagcctagccccaaacaggacgtggtgggaaaaaccccacctagcacaaccgtaggcagccacagcccaccagaaacccccgtcctgacaaggtccagcgcgcagacatcagcggcaggcgctaccgccactaccagcacctcctcaaccgtcactgtgaccgccccagcacccgcagccactggcagccccgtgaagaagcagcggcctcttctacccaaggagacagccccagctgtgcaaagagtagtctggaattcaagtactgtgcagcagaaagagatcacgcagtcgccgtctacctccacaatcacactggtgaccagcacccagtcaagtccattagtcacttcttctggaagcatgtccaccttggtcagtagcgttaatgcggacctgcccattgcgactgcttcagccgacgttgccgctgacatcgcaaagtacacatctaagatccggagactccgtatagagattgagaagttgcaatggctgcatcagcaggaactgtctgagatgaagcacaacctcgagttgaccatggccgaaatgcggcagtctttagaacaggaaagggacaggctcattgcagaagtaaagaaacagctagagctagagaaacagcaggcggtggacgaaactaaaaaaaaacaatggtgcgccaattgtaaaaaggaggccattttctactgctgctggaacacatcttattgcgattatccctgccagcaggcacattggccagagcacatgaagtcatgtactcagtccgccactgctccacagcaagaggctgatgccgaagtcaataccgagactttaaacaagtcatctcagggctccagcagcagcacgcagtctgcgccaagtgaaactgcaagtgcttcgaaggagaaagaaacaagcgctgagaagtcgaaagagagtggctctaccctggatctgagtggttcacgcgaaaccccaagtagtatcttgctgggctcgaaccagggatccgtgtcgaaacgctgtgataagcaacccgcatacgcaccaacaacaaccgaccatcagccgcacccaaactaccctgcccagaaataccactccaggtcaaataaaagttcatggagcagctcggacgaaaagcgaggttcaactcggtctgatcataatacatctacctcaacaaagtctctcctgcctaaagaatcacgtttggacactttttgggattag

SEQ ID NO: 26011 - DNA, 3561 bp, Artificial Sequence
  Description of Artificial Sequence: Synthetic coding sequence
atgtttagctccttgcagaagagctttaatttggcagaagaggaaattaagactgagcaggaagtggtagaagggatggatatctctacccgttctaaggatcccggatctgccgagcgaaccgcccagaaacgcaagtttccatcaccaccacattcatctaatggccacagtcctcaagatacctctaccagcccgattaagaagaagaagaagcccggtctgctcaacagcaataataaggagcaagatgggagaaatgatttctactgttgggtgtgccatcgcgaggggcaggtactttgttgtgaactctgccccagagtgtatcacgccaagtgcctccggctcactagtgaacctgagggggattggttctgccccgagtgcgagaaaattaccgtggcggaatgcatcgagacgcagagtaaagcaatgacaatgctgactatcgaacagctgagttatctgctcaagttcgcgattcaaaaaatgaagcagccaggaacagatgcattccagaaacctgtaccattggaacagcaccctgactatgctgagtatatctttcatccaatggacctctgcaccttggaaaagaatgcaaagaagaaaatgtacggctgtaccgaggctttcctggccgatgctaagtggatactgcacaattgcatcatttacaatggagggaatcataagctgacccagattgctaaagtcgtgattaagatctgcgagcatgaaatgaacgagatcgaggtgtgtccagaatgttatctggccgcttgtcaaaaacgcgataattggttttgcgaaccctgttcaaatccccatccactggtgtgggctaagttgaagggatttccgttttggccagctaaggccctcagagacaaagacgggcaggtcgatgcgcgtttttttggccaacatgaccgagcttgggtgcccattaataactgctaccttatgtctaaggaaattcccttcagtgttaaaaaaacgaagtctatcttcaatagcgcgatgcaggagatggaggtgtacgttgagaacattcggagaaagttcggcgtttttaattacagcccattcagaaccccgtacacgcctaactcccagtaccagatgcttctggacccgacaaatccttccgcgggaacagcgaagatcgataaacaggaaaaggtcaaattgaacttcgacatgacagcctcaccaaaaatccttatgagcaaacccgtgctttcggggggaaccggccgtcgaatttccttgagcgatatgccaagatcgcccatgtcaactaatagcagcgtgcacactggttcggatgtggaacaggacgccgagaaaaaggccacaagcagtcatttcagcgcctcagaggagtctatggatttccttgataagagtacagcttcacccgctagcaccaagacagggcaggccggttccctgtcaggatctcccaaaccattctctcctcagctgtccgccccaatcacaacaaagacagacaaaacgtccactactgggagtatactgaatctaaatttggaccggagcaaggctgagatggacctgaaagagttgagcgagtccgtccaacagcaatcaacccctgtcccccttatcagccctaaacgccaaataaggtcaagatttcagttgaacttggataagaccatcgaaagctgcaaggcacagctcggtatcaacgaaatttcggaggatgtgtataccgccgtcgagcacagcgactctgaagactcagagaagagtgactcctcagactctgaatacatctctgacgacgaacaaaaatcaaaaaatgagcctgaggacaccgaagacaaggagggctgccagatggacaaggaaccatccgcagtgaagaaaaagcctaaaccaactaaccctgtagaaatcaaggaagagctcaaaagtacatcccctgcctccgagaaggcggacccaggcgctgtaaaagacaaagctagccctgaaccagaaaaagatttttccgagaaggccaagccgagtcctcatccgataaaagataagctgaagggcaaagatgagactgattcaccaaccgtgcacttaggccttgactcagatagcgaaagtgagctggtgatagacttgggcgaagaccactccggaagggaaggcagaaaaaacaaaaaggagcctaaggagccctctcctaagcaggatgtggttggaaaaacaccgcctagcaccacagtcgggagtcactcaccccctgagacccccgtcctcacaaggtcatctgcacagaccagtgctgccggagcaacagcaaccacaagtaccagctccaccgtgaccgtgaccgctcccgctcctgccgctaccgggtctccagtgaaaaagcaacggcctctacttcccaaagagacagcgccagctgtgcaaagagttgtgtggaacagcagctccaaatttcagactagctcccaaaaatggcacatgcagaagatgcagcgacagcagcagcaacagcaacagcagaatcagcagcaacagcctcagtcttcacaaggtacgcggtaccagacacgacaagccgtgaaggctgttcaacagaaggagataacccagtcgccctcaacaagcaccataacactggtgacaagcacacaatcttctcccctcgtcacttcatccggtagcatgtctactctggtctctagcgtgaacgcagacttaccaattgccacagccagcgcagacgttgccgcagatattgccaaatacacctctaagatgatggacgccatcaagggtaccatgacagagatctataatgatctttcaaagaacacaaccggatccacaatcgccgagatccgaaggcttcgcatcgaaatagagaagctgcagtggctgcatcagcaggagctctctgagatgaagcacaacctggagctgacaatggctgagatgcgccagtctttggaacaagagcgggatcgattgattgccgaagttaaaaagcagctggaactggagaaacaacaggccgtggacgaaaccaagaagaaacagtggtgcgctaattgcaagaaggaggccattttttattgctgctggaacacctcttattgtgattatccctgccagcaagcgcactggcccgagcacatgaagagctgtacccaaagcgccactgcgcctcagcaggaagctgacgcagaagtgaacacggagacccttaacaaaagctcacaggggtccagctcatctacccaatcagccccttcagaaacagcgtctgcttccaaagagaaggagacctcagccgagaagtcaaaagagagtggatccacattagatctctccggatcaagagagacaccgagtagtatcctgctgggcagtaaccagggcagcgaccactcaagatctaacaaatcatcttggagcagctcagatgaaaaacgcggtagtaccaggagtgaccacaacaccagcacgtcaaccaagagtctgctgccaaaagagtctcggttggacacattctgggattag

SEQ ID NO: 26012 - DNA, 75 bp, Artificial Sequence
  Description of Artificial Sequence: Synthetic coding sequence
atggacatcagtactaggagcaaggacccagggagcgcagaacgtaccgcccaaaaacgaaaatttccttcctag

SEQ ID NO: 26013 - DNA, 129 bp, Artificial Sequence
  Description of Artificial Sequence: Synthetic coding sequence
atggatatctccactcggtccaaagatccgggtagcgccgagcgcactgcgcagaagcggaaattcccatcaccccctcatagcagtaatggacactcaccacaggacacatccactagtcccatttag

SEQ ID NO: 26014 - DNA, 3318 bp, Artificial Sequence
  Description of Artificial Sequence: Synthetic coding sequence
atggatattagcactcgttcaaaagacccaggctctgcggagaggacggctcagaagcggaagtttccatccccaccccactcctcgaacgggcatagccctcaggatacgtctacaagccccattaaaaaaaagaaaaagcccggattgcttaattcaaataataaggagcaggatggcagaaatgacttttattgttgggtttgtcacagagaaggacaagtactgtgctgcgagctctgtccaagagtgtatcatgcaaaatgcctgcgcctgaccagcgagcccgagggcgactggttctgccccgagtgtgagactgacgcattccagaagccagtcccactggagcaacaccccgactatgcggagtatatatttcaccctatggatctgtgcactttggagaaaaatgccaagaaaaaaatgtatggttgtacagaggcttttcttgccgacgcaaagtggatccttcataactgcatcatttacaatggcggaaaccataagttaacccaaatcgcaaaagtcgtcattaagatatgcgagcatgaaatgaacgagatcgaagtctgtcccgagtgttacttagcagcctgccagaaacgcgataattggttctgtgagccctgctcaaacccccatcctttggtttgggcaaagctgaaaggatttccattttggcctgcaaaagccctgagggataaagatgggcaggtggacgccagattctttggacagcatgacagggcctgggtacctatcaacaattgctacctcatgtccaaggaaatccctttctccgtgaagaagactaagagcatcttcaattctgccatgcaagagatggaggtgtacgttgagaacatcagacgcaagtttggcgtattcaactatagtccattcaggacaccatacactccaaattcacagtaccagatgctgctggacccaacaaatcccagcgccggtactgctaaaatcgacaagcaagagaaagtaaagcttaacttcgacatgactgcctcccccaagatcctcatgtctaagcccgtgctgagtgggggaacgggcagacgaatcagcctgtcggatatgccaagaagtcctatgagtactaactcgtccgtacatacaggctccgatgttgaacaagatgcagaaaagaaggccaccagctcccacttcagtgcctccgaggagtctatggacttcctcgataaatcgacagcatctcccgcaagcacaaagactggacaagcaggcagtctgtccggaagtcctaaaccattttcgcctcagctgtcagccccaatcaccacaaagacagacaagactagcacgaccggctctatactaaatctcaatctggacagatccaaggccgagatggacttgaaggagctatccgagtctgtccagcagcagtctacgcctgttccactgatctcacccaaaaggcaaatacgctcacgctttcagctgaaccttgataagaccatcgagtcttgtaaggcacagctgggaataaacgagatcagtgaagatgtgtataccgcagtggaacatagcgattctgaggatagtgagaaatccgattcttccgatagtgaatacatatccgacgatgagcagaagagtaaaaacgaaccagaggacaccgaggacaaggagggctgtcagatggacaaagagccaagtgcagtgaagaagaaacccaagcctacgaaccccgtggaaattaaggaggagttgaagtcaacatctcccgcttcggaaaaggccgaccctggtgccgtaaaggacaaggcctccccagagcccgagaaagacttcagtgagaaagccaaaccttctccacacccaattaaagacaaactgaaagggaaggatgaaactgattctccaaccgttcacctcggattagatagcgattctgaatctgaacttgtcatcgaccttggggaggatcatagtgggagggagggtaggaaaaataagaaagagcctaaagagccttccccaaaacaggatgttgtgggaaaaaccccgccaagcaccacggttgggtcccattctcccccagagacacctgtgctgactcggtcctctgcccagacgagtgcagccggagcaacagcaacgactagcacgtcctccacggttactgttactgccccagccccagctgccactggatctccagtcaagaaacagcgcccactcctccctaaagaaacggcacctgccgtccagagggtggtctggaattcttcaactgtccagcaaaaagagatcactcagagcccatccaccagcaccataaccttagtgacttcaacgcagtcctcccccctggtcaccagctctggttctatgagtactctggtatcctctgtgaatgcagacttgccgattgcaacagcttccgcagacgttgccgctgatatcgccaagtacacctcgaagatgatggatgccatcaagggaactatgaccgagatctacaatgatctctccaagaacaccaccggctccaccatcgccgagatccgcaggctcaggatcgagatcgaaaagttgcagtggctccaccagcaggagttatccgagatgaagcacaacctagagcttaccatggccgagatgagacagtcattggaacaagaacgcgatcgtttgatagctgaggtgaaaaaacagctcgagctggagaaacagcaagcggttgatgagacaaaaaaaaagcaatggtgtgctaactgcaaaaaagaggccatcttctactgctgctggaatacctcctactgcgactacccttgtcagcaggctcactggcctgagcatatgaaaagttgcactcaatcggcaaccgcacctcagcaagaagctgacgcagaggtaaatactgaaacactcaacaagtcctcccagggatcctcaagctctactcagtccgccccatcagaaacagcttcggccagcaaggaaaaagaaacctccgcagaaaagagcaaggagagcggtagcaccttggacctgagcggcagcagagagacaccctcctctatattattagggagcaaccagggatctgtttcaaaaagatgtgacaaacaaccagcctacgctcctacaacgaccgaccaccagccacatcctaactatcctgctcagaaataccattcacgatccaacaagtcatcttggtcaagttctgacgaaaagcgcggaagcacccggtctgatcacaatacttctacgtcaactaagtctctactgcctaaagaaagccgcttagacaccttctgggactag

SEQ ID NO: 26015 - DNA, 3567 bp, Artificial Sequence
  Description of Artificial Sequence: Synthetic coding sequence
atgcatccacagtccctggccgaggaagaaataaagacagagcaggaggtcgttgagggaatggacattagcaccagaagcaaggaccccggatccgcagaaaggaccgcccagaaaagaaaatttcctagcccaccccattcctctaatggtcactcaccccaggatacaagcacaagccccataaaaaagaagaagaaacccggactgctgaactcgaataacaaggagcagtccgagctgagacatggccctttctactacatgaaacagcctctcaccaccgatccagtggacgtggtcccccaagatggccgaaacgacttttattgttgggtgtgccatcgcgaggggcaggtcctgtgctgcgagctatgcccgagggtttaccacgccaaatgtctccgactcacctccgagccagagggagactggttctgtcctgagtgtgaaaagatcacagtggcagagtgtatagagacgcaatccaaagctatgaccatgcttactatagagcagctatcttatctcttaaagtttgctatacaaaagatgaagcagcctggcaccgacgccttccagaaaccagtgccgttggagcaacaccctgattatgccgaatacattttccatcccatggatctctgcaccttggagaagaacgcaaagaagaaaatgtacggctgcaccgaagccttcctcgccgatgctaaatggattctgcacaactgtatcatttacaatgggggaaaccacaaactcacccagatcgccaaggtcgtgatcaagatctgtgaacatgagatgaatgaaattgaggtgtgtccagaatgttacctggctgcttgccagaaacgggataattggttttgcgaaccttgctcaaacccgcacccactggtgtgggccaagctgaaggggttccccttttggccggctaaggctcttcgagacaaagacgggcaggtggatgcaagatttttcgggcagcacgacagggcatgggtacccatcaataactgctacctcatgtctaaagaaattcccttctcagttaagaagaccaagtcaatcttcaacagcgccatgcaggaaatggaggtgtatgttgagaatataaggcgcaagtttggagtcttcaactattcccccttcaggactccttatactccaaattctcagtatcaaatgctgctggatccaacgaacccatctgcaggaactgcaaaaatcgacaagcaggagaaggtcaaactcaactttgacatgaccgccagcccaaaaatactgatgtctaagcccgtactctcgggcggaacaggtagaagaatctcattatcggatatgcccagatcgcccatgtctactaatagcagcgttcataccggctcagacgtggagcaggatgccgaaaagaaagccactagcagccatttctctgcaagcgaggagtccatggacttcctggataagtcaacagcttcccccgcttccacaaagaccggtcaggccggatctttatctggcagccccaagcctttcagtccccaactctcagcccctataacaactaaaactgataagacctcgaccacaggcagtattctcaatctgaatctggataggtcaaaggcagagatggacttgaaggaactgtccgaaagcgtgcaacagcaatcaaccccagtgcccctgattagccccaaacggcagatccgctctaggttccaactgaacctggataagaccatcgagtcttgtaaagctcagctgggcatcaacgagatctctgaggatgtgtacaccgccgtggagcacagtgactccgaggatagcgagaagagtgatagcagcgactcagaatacatttcagatgacgagcaaaagtccaagaacgagcctgaggacaccgaagataaagaggggtgccagatggataaagagccatctgcagttaagaaaaaacctaagccaaccaacccagttgagattaaagaagagctgaaaagtacaagccctgcctccgagaaagctgatccaggagccgtgaaggataaggcctcccccgagcctgagaaggattttagcgaaaaggccaaaccctccccgcacccgattaaagataaactgaaaggaaaggatgaaactgatagccccactgtacatttgggtcttgacagcgactccgaatctgaactggtcattgacctgggcgaggatcattcggggagagagggcagaaagaacaagaaggagcctaaagagcctagccccaagcaagacgtggtcggaaaaaccccaccatccacaaccgttggctcacacagcccaccagaaacacctgtcctcacccggtcaagtgcccagacctctgccgcaggggctactgccaccactagcacttccagcactgttacagtaaccgcccctgccccagcagcaacaggctcccccgtcaagaagcagagacctctactgccaaaagaaacagcccctgcagtacagcgtgttgtctggaactcgagcacagtacagcagaaagaaatcacacagagtcccagcaccagcaccataaccctggtcacatccacccaaagttcccctctcgtcacctcctcagggtcaatgtctaccctcgtctcctctgtgaatgctgatttgcccattgcaaccgcctctgccgatgtcgccgcagacattgcaaagtatactagtaagatgatggacgccatcaaaggtaccatgacagaaatttacaatgacctgagtaagaatacaacaggttcaactattgccgagatacggcgtctccgcatcgaaatcgaaaagctgcagtggttacatcaacaggagctgtccgaaatgaagcacaacttggaactcaccatggcggagatgaggcagtccctcgaacaggaaagggatcggctgattgccgaggtgaagaagcaactcgagctggagaaacagcaggctgtcgacgaaactaaaaaaaaacaatggtgtgctaactgtaaaaaggaggccattttctattgttgctggaacacaagctattgcgattatccctgccagcaggcacactggccagaacacatgaagtcttgcacgcagtccgctaccgcaccccagcaggaggccgacgctgaagtgaacaccgagactctgaacaagagtagccagggcagttcctcaagcacccaatcagctccatcagagacagcctctgcctctaaagagaaggaaactagcgcagagaaaagcaaggaatcgggttctactttagacctcagcgggtctcgagaaacgccttcgtcgatcctgctgggctcaaaccagggctccgtgagtaaaagatgcgataaacagcccgcttacgcgccaactaccaccgatcaccaaccccaccctaattatcctgctcaaaaatatcatagtcggagcaataaatcaagctggagtagtagtgacgaaaaacgcggatcgaccagaagcgaccataatacctcaacatcaaccaagtccctcttaccaaaggagtcccggctggataccttttgggactag

SEQ ID NO: 26016 - DNA, 3291 bp, Artificial Sequence
  Description of Artificial Sequence: Synthetic coding sequence
taaacggatcccgtcgatgtggtgcctcaggatgggaggaatgacttttactgctgggtgtgtcatagagaaggccaggtcctgtgttgtgagctctgcccgcgagtttatcacgctaaatgtttgcgcctaacctcggagcctgagggggactggttctgtccggagtgtgagaagataacggtggccgagtgcatcgagactcagtccaaggcgatgaccatgctgactattgagcagctgtcatatcttttgaaattcgccatccaaaagatgaaacagcctggtaccgatgcgtttcaaaaacccgtgcccctggagcagcaccctgactacgccgagtacatctttcaccctatggacctgtgcaccttagagaagaacgctaagaagaaaatgtacggctgcacagaggcttttttggccgacgcaaagtggattctacacaactgcatcatttacaacggcggaaatcataagctgacccagattgccaaagttgtgattaagatttgcgagcacgagatgaacgaaattgaagtgtgtcccgagtgctacctcgcagcatgccagaaacgcgataattggttctgcgagccatgttcaaacccccacccactcgtgtgggccaaattaaaggggttccctttctggcccgctaaagccctacgcgacaaagacggccaagtggatgctcggttttttggtcaacacgatcgggcttgggttccgatcaataactgctatttgatgtctaaagaaatcccattctcggttaaaaagaccaaatccattttcaacagcgccatgcaggagatggaagtatacgtggagaacatcagacggaagtttggtgtgttcaactactccccatttaggacgccctacacgcctaacagtcagtaccagatgttacttgaccctactaaccctagtgcaggcaccgctaagatagataagcaggaaaaagtgaagttaaactttgacatgacggcatctcccaagatcttgatgtcgaagcccgtcctgtccggcggtactggaagaagaataagcctcagcgatatgccgagaagtccaatgtctacgaattcctcggtccacactggctccgatgtggaacaggacgctgagaaaaaggccaccagctcccacttctccgccagtgaagaatccatggacttcctcgataagtccacagcttccccggcatccacaaagactggtcaggcagggtccttgtctggctcgccgaagcccttttcaccacagctttctgcgcctatcaccactaaaactgacaaaacctcaactaccgggtcaatcttaaatttaaatctcggacacaggagcaaggccgaaatggacttaaaagagctgtcggaaagcgtccaacaacagagtacacccgtgccactgatctcaccgaagaggcagatcaggagtcgatttcagcttaatctggacaagaccattgaatcttgtaaggcacagctcggcatcaacgagatctccgaggacgtgtatactgccgtggagcactctgactccgaggactccgagaaaagtgacagcagcgactccgagtacatcagcgacgatgagcaaaaatcgaagaacgagccggaagacaccgaagataaagaaggatgccaaatggacaaagagccaagtgcggtcaaaaaaaagccaaagcctaccaacccagtggaaatcaaggaagagctcaagagcacatcccctgccagtgaaaaagcggatcctggcgctgtgaaggataaagcatctcccgagcctgagaaggatttttcagaaaaagctaaaccaagtcctcacccaattaaggataaactcaagggaaaggatgaaaccgacagccctaccgtgcatctcgggctggactctgacagtgagtcggaattagtgattgacctgggcgaggaccattcaggcagggagggaaggaagaataaaaaggagcccaaagagcctagcccaaagcaagacgtagtcggaaaaaccccaccctccacgactgtaggctcgcacagcccccctgaaactccagtacttacgaggtcatcagctcaaacctccgctgccggtgcgacagccaccaccagtaccagctctacagttaccgtgacagcacccgcaccagcagcaacgggcagccccgtgaagaagcagcggcctctcttgcctaaggagaccgccccagccgtacaacgcgtggtctggaatagtagcaccgtccagcaaaaggaaattacgcagtcgccaagcacctccacaattacacttgtcacaagcacccaaagctctcctctggtgacctcatcaggtagcatgtccacactggttagctcggttaatgccgatctgccaatcgcaactgccagcgccgatgtggccgctgatattgctaagtatacctccaagatgatggacgctatcaaaggaacaatgacggaaatctacaatgacctctccaaaaataccacaggctcgactatcgctgaaatacggcgattgcgcatcgaaatcgagaagcttcagtggctgcaccagcaagaactaagcgagatgaaacataatctcgagcttaccatggctgaaatgcgccagtctttggagcaggagcgcgacagactgatcgcagaggtgaaaaagcaactcgagctggagaaacagcaagcagttgatgagacaaagaagaagcagtggtgcgcaaattgcaagaaagaagcaatcttctactgctgttggaataccagctactgcgattatccttgccagcaggctcattggccagaacatatgaaaagttgcacacaatcagctacagctccccagcaggaggccgacgccgaggtgaacaccgaaacgcttaataagtcctcccagggtagtagttcctcaacacagagtgcgccttctgagaccgcaagcgcatcgaaggagaaagagacctcagctgaaaagtctaaggaaagcgggagcactcttgatttgtccggctcgagggaaacacctagcagcatcctgctcgggagcaaccaaggatctgtctctaaaagatgtgataagcaaccagcctatgcacctactacaacagaccatcagccacacccgaactaccctgcacagaagtaccactctcgctccaacaagtcttcttggagcagctccgacgagaagcgcggtagtacgcggagtgatcacaacacgtcgacttcgactaaatcattactgcccaaagagtcccggcttgacactttttgggactag

SEQ ID NO: 26017 - DNA, 3726 bp, Artificial Sequence
  Description of Artificial Sequence: Synthetic coding sequence
atggtttttctcgaggagtttgaagcgaggtcctgtctcgcagaagaggagattaaaaccgagcaggaggtcgtggaggggatggatatttccaccagatctaaggacccgggatcagctgaaagaaccgcgcagaagcgaaagtttccgagtcctccacatagcagcaacggacattctccgcaggatacatcaacgtcccccataaaaaagaagaaaaagccagggttgctgaatagcaacaacaaagagcaatccgagctgcggcatggccctttttactatatgaagcaaccactgaccacagatcccgtggatgtcgtcccccaggacgggaggaacgatttctactgctgggtgtgccatcgcgagggacaggtactttgttgcgagctgtgcccgagggtataccacgccaaatgtctcagattaaccagtgaacctgagggggactggttctgccctgaatgtgagaagatcacagtcgcagagtgcatcgaaactcagtctaaggctatgacaatgcttaccattgaacaattgagctaccttctcaagtttgccatccagaaaatgaagcagcctgggacagatgccttccaaaaaccggtgcccctggagcagcatcccgattatgcggagtacatcttccacccgatggatctgtgtactttggagaagaacgctaagaagaagatgtatggatgcacagaagctttcctggctgatgccaagtggattcttcacaattgcattatctataacggcggtaaccacaagttgactcagatcgctaaggtagttataaaaatctgtgagcacgagatgaatgagattgaagtgtgccctgaatgttatctggccgcatgtcagaagcgggacaattggttttgcgagccatgctccaatccacatccattggtgtgggctaagctcaagggctttcctttctggccggcaaaggccctcagggataaagacggccaagtcgatgcgaggttcttcggacagcacgacagggcatgggtccctattaacaattgctacctgatgtcaaaagaaattccattcagcgtaaagaaaactaagtctatttttaactccgcaatgcaggagatggaggtgtacgtggagaacatcagacggaagttcggtgtctttaattacagtcctttccgaaccccatacacccctaattcccaataccagatgctactggaccccaccaatccttccgctggcactgctaaaattgataaacaagagaaagtaaagcttaatttcgacatgaccgcttcacctaagatcctgatgagcaagccagtgctgtctgggggaaccggcaggcggataagtctgagcgacatgccacgctcccctatgtcgacaaattcatctgtgcacactggcagcgatgtggagcaagacgcagagaaaaaggctaccagtagccacttttccgcatccgaagagagtatggacttccttgacaagagtactgcaagtccagccagcaccaagaccggacaggctggctccctgagcgggtccccaaaaccgttcagcccccaattgtctgcccctatcaccacgaagaccgacaagacctcaacaacagggtctatcctcaatttgaacctggatcgctctaaggcagagatggatctgaaagaattgagtgaatcagtgcagcagcagtcaactccagttccacttatttcccccaaacgccaaattagaagtcgttttcagttaaatttagacaagacgatagagtcctgtaaagcacagctggggattaatgaaatttcggaggacgtgtacactgccgttgagcattccgactctgaagattccgaaaaaagcgactctagcgattcagagtatatttccgatgatgagcagaagtccaagaacgagcccgaggacacggaagataaagagggatgtcagatggacaaagaaccctctgcagtgaagaaaaagcctaagccgactaacccggtggaaattaaggaggaattaaagtccacaagccctgctagcgagaaggcagatccaggcgctgtaaaagacaaagctagccctgaaccggaaaaagacttcagcgaaaaggctaagccctctcctcatcccataaaagacaaattgaagggtaaggacgaaactgacagccccacagtgcatctcggacttgactccgacagtgagtctgagctcgtgatcgacctgggcgaagaccattccggtcgggagggacgaaagaacaagaaagaacccaaagaaccttcccccaaacaggatgtcgtggggaagactcctcctagtacgactgtcggatcccacagcccccctgagaccccagtgctgactcgctcttccgcgcagacaagcgctgccggagcaactgccacgacatctacatccagcacggtgaccgtcacggcccctgcaccagccgctacaggatcgcccgttaaaaaacaaaggcccctgctcccgaaagagaccgctcctgccgtgcagagggtggtctggaactcaagtagcaagttccagacctcctcccagaaatggcatatgcaaaagatgcaacggcagcagcagcaacagcagcagcagaatcagcagcagcaaccccagtctagccaggggacaaggtaccagacgaggcaggctgttaaggccgtgcagcaaaaagagataactcagagccctagcacaagtacgattacattagtgaccagtacacagtctagtccattggtgaccagctccggctctatgagtacattggtgagttctgtgaacgccgatttgccaattgccaccgccagtgctgacgtggcggctgatattgccaagtatacatcaaagatgatggacgccataaagggaacaatgaccgaaatctacaatgacctctcaaagaacacaacaggtagcactatcgcagaaataagacgactcagaatcgagattgagaaactacaatggttacatcagcaagagctcagcgaaatgaagcacaaccttgagctcactatggccgagatgcgtcagtctctagagcaggagcgcgaccgtctgatagccgaagtgaagaagcagctggagctcgagaagcagcaggcggtcgacgagactaagaagaagcagtggtgtgctaattgtaagaaagaagctattttttattgttgctggaatacatcttattgcgattatccttgccagcaggcacactggccagaacacatgaagtcgtgtacccagagtgccactgcccctcagcaggaagctgatgctgaagttaacaccgaaacactcaacaagtcatctcaaggtagctcctcgagcacccagtccgctccaagtgagacggctagtgcctccaaggaaaaagaaacctccgctgaaaaatccaaggagtctgggagcacactcgatcttagcggctcgcgcgaaacgccaagctctatccttctgggttccaaccagggtagcgtatctaaacgatgcgataaacagcctgcgtatgcaccaacgaccacagatcaccagccacatcctaactaccctgcacagaagtatcatagtaggtccaataaaagttcttggtcatcctcagatgaaaaacgaggctctaccaggagcgaccacaatactagtacgagtacaaaatctcttctgccaaaagagtccaggctggataccttttgggattag

SEQ ID NO: 26018 - DNA, 3405 bp, Artificial Sequence
  Description of Artificial Sequence: Synthetic coding sequence
atgcacccccagtcgctggctgaagaggaaatcaagaccgaacaagaagtggtagaggggatggatatctctacgcgctctaaggaccccggaagtgctgaacgtaccgcacagaagagaaaattcccgtcacctccgcatagtagtaacggccacagcccccaggacacgtctacttcaccaattaaaaaaaagaagaagcctggcctactgaacagtaataacaaagaacaagacggacgtaacgacttttactgttgggtctgtcatagggaagggcaggtgctgtgttgcgagttatgccccagggtgtatcatgcaaagtgtctgagactgacgagcgagcctgagggggattggttctgccccgagtgtgaaaaaatcaccgtggccgaatgcattgagacccagtctaaagctatgacgatgctgaccattgagcagctgtcataccttctgaaattcgctatccagaaaatgaagcaaccgggtactgacgcctttcagaaacctgtccccctcgaacagcaccctgactatgcagaatacatctttcaccccatggatctctgcacccttgagaaaaacgcgaagaagaaaatgtacgggtgtaccgaggcattcttagctgatgccaaatggatcctgcataattgcatcatttacaacgggggaaaccataaactgacccagatcgccaaagtggtgatcaagatatgtgagcatgaaatgaatgagattgaagtctgccccgagtgttatctagctgcatgtcaaaagagggacaattggttttgtgaaccctgtagcaatccacaccccctggtatgggcaaaactgaaggggttcccgttttggccggctaaggcattacgcgacaaggatggccaggtggatgcacggtttttcggtcagcatgacagagcatgggtgccaattaacaattgttacttgatgagcaaggaaatcccctttagcgtaaagaaaactaagtctatcttcaactcagcaatgcaggagatggaggtctatgtggaaaacattcggagaaagttcggtgtcttcaactactccccctttaggaccccatatacacccaattctcagtatcagatgcttctggatcccactaatccatccgcgggaaccgccaaaatcgacaaacaagaaaaggttaagcttaacttcgatatgaccgccagccccaaaattctgatgtccaagccagttctctccggaggaactggtcgcaggatctccctgtctgatatgccaaggtcaccaatgagtaccaacagtagtgttcacacaggctctgacgtcgaacaggacgctgagaaaaaggccacgtcatcacactttagtgcatctgaggagagcatggatttcttagacaaaagcactgacagaagtaaggctgaaatggacctcaaagagttgagcgaatctgtccaacaacaatcaacccctgtcccgttgatctcccctaaaaggcaaatacggtcccgtttccaattgaacctggacaagactattgaatcctgcaaggcccagctgggcatcaacgaaatttccgaggatgtttatacggctgtggagcactcagactctgaggactctgagaaatctgatagctcagatagcgagtatatctcggacgacgaacagaaaagcaaaaacgaaccggaagataccgaggataaagaaggctgccagatggataaagagcctagtgctgtaaagaagaagcccaaacctaccaatcctgtggagattaaggaagaactgaagtcaacctcccctgcctctgaaaaggccgatcccggagccgtcaaggataaggcgagcccagagccagagaaggacttttctgaaaaagcaaagccgtctcctcacccaatcaaagacaagctcaagggcaaagacgagacggacagccccaccgtacacctgggccttgactccgatagcgagagtgaactcgttatcgatttgggagaagatcactccggaagggagggaagaaagaacaaaaaagagcctaaagagccttccccgaagcaggacgtcgtgggaaagactccgccatcaacaacagtgggctcccactctcccccagaaactccagtgcttacccggagtagtgcccagacatccgccgctggagccacagctaccacctcaacaagcagtacagtaactgtgaccgctcccgctcctgctgccactgggtcacccgtgaagaaacagaggcccttgctccctaaagagaccgcccctgccgtgcaacgggtagtttggaactcctcatcaaaatttcagacgtccagtcagaaatggcatatgcagaagatgcagcgtcaacagcaacagcagcaacaacagaatcagcaacagcaaccacaatcctcccaaggaaccaggtaccagactaggcaggctgtgaaagctgtgcaacaaaaggagattacccagtccccttctaccagtactattaccctggtcacgtctacgcaatcaagtcccctcgtcacgtcatcaggcagtatgtccacgctcgtttcgtccgtcaacgcggacctgcccatcgcaacggcaagcgctgacgtagctgcagacatagccaagtacacgagcaaaatgatggatgcgatcaaggggacaatgaccgaaatatacaatgatctgagtaaaaatacaaccgggtccaccatagccgaaatccgacggctccggatagaaattgaaaaactgcagtggctgcaccagcaggaactctctgaaatgaagcacaacctggagttaaccatggccgagatgcgccaaagcctggaacaagagcgcgatcgcctcatcgccgaagtgaagaaacagttagagcttgagaagcagcaagctgtagatgaaaccaaaaaaaagcaatggtgcgctaactgcaaaaaagaggcgatcttctactgttgttggaacacaagctactgcgactacccctgtcagcaggcccactggccggagcacatgaaatcttgcacccagtccgccacggcccctcagcaagaggctgatgctgaagtgaacacagagacactgaataaaagctcgcagggatcatccagttcgactcaaagcgcaccttccgagaccgcctccgctagcaaagagaaggaaacatctgcggaaaaaagcaaggagtctggctctactcttgacttatcaggtagcagggaaacccccagcagcatcctccttggttccaatcaaggcagtgaccatagccgtagtaacaagtcatcatggtcttccagcgacgaaaagaggggatctacgcggtctgatcacaatacttccacttccactaaatccttattgccgaaagagtcgcgattggacaccttctgggactag

SEQ ID NO: 26019 - DNA, 2805 bp, Artificial Sequence
  Description of Artificial Sequence: Synthetic coding sequence
atggaggagcgaagaccccacctggatgcgagacccagaaactctcacaccaatcataggggaccagtggacggggaactgccccctcgggcacgaaatcaggcaaataaccctccagcaaacgctctccgtggaggggctagccacccaggccgacaccccagagcgaacaatcacccagctgcttactggcagagggaagagaggttccgcgctatgggtaggaaccctcaccaggggaggcggaaccaagagggtcacgcttcagacgaggccagagatcagcgccatgatcaagaaaacgatactcgttggcgcaatggcaatcaggactgccgcaatcgtcgcccaccttggagcaacgataatttccagcagtggcgtactccgcaccagaagccgacagagcagccacagcaggcaaaaaagttgggctacaaatttctggagtcgttgctgcagaaggatccttccgaggtggtgataactctcgcgacatccctggggctgaaagagcttttatcccacagcagcatgaagagcaactttttggaactgatatgtcaggtgctgaggaaagcctgcagctccaaaatggatagacagagtgtcttgcacgtgcttgggattctcaagaatagtaaatttctgaaggtctgcctccctgcctatgtagtgggaatgatcacggaacccatccctgacatccgcaaccagtatccagagcacatctctaatattatcagtctgctgcaggatttggtctccgtgttccccgcttcctcagttcaggaaacttctatgctggtgtccctgctgcccacttcgctaaatgcgctgcgggcttctggagtggatattgaagaggagacagagaagaatctggaaaaagtgcagactattattgagcatctgcaggagaaaagaagggagggaaccctgcgcgtggacacttatacactcgttcagcctgaagctgaagaccacgtggagagttatagaactatgcccatctatccgacctataacgaagtgcatttagacgagcgaccattccttagaccgaacattatttccgggaagtacgactcaacggcgatttacttggatacacattttagacttctgagggaagatttcgttcgaccgctgcgcgaaggcatcctcgagctacttcaaagctttgaggatcagggtttgcgcaagcggaaattcgacgacattcgcatttattttgatactaggatcatcacgccaatgtgctctagctcaggcatagtgtataaagtacaattcgatacaaagccattgaagtttgtacggtggcagaattcaaaaaggctgctgtacggctctctggtatgcatgagcaaagacaatttcgagacttttctcttcgccaccgtctcaaaccgagagcaggaggatctgtgcagaggcatcgtgcagctttgctttaacgagcaaagtcaacagctgttggccgaggtgcagcccagcgacagcttcctgatggttgaaactaccgcatacttcgaggcttacagacacgtgctggagggcctgcaagaggtgcaggaggaggacgtgccttttcagcgaaacatcgttgagtgcaactctcacgtaaaggaacctcgttatcttctgatgggagggcgttacgattttaccccacttatcgagaaccccagcgcgacaggagagtttctacggaacgtggaaggactgaggcatccacggatcaacgtattagacccgggtcagtggcccagtaaggaggctcttaagctcgatgactcccaaatggaggctctgcaattcgccctgactcgtgagctggcaattatacagggtccccctggcacaggcaagacgtatgtggggctgaagatcgttcaggcgctattgacgaacgaatctgtttggcagatcagcctgcagaagttcccgatactggtggtttgctatacgaatcatgcattggaccaattcctggaagggatctataactgtcaaaagacaagcatcgtgcgggtagggggacgatcgaactccgaaattctgaaacaattcactcttcgggaactgcgtaacaaaagagagtttcgaagaaatctgcctatgcatctgagacgcgcatacatgtcaattatgacacagatgaaggagtcagaacaggagttgcatgaaggagctaagacactggagtgcacaatgaggggcgttctgcgcgaacagtatttgcagaaatatatttccccgcaacattgggaatctctaatgaacggacccgtgcaggactctgaatggatctgtttccagcactggaaacactcgatgatgcttgaatggctcgggctaggcgttggttctttcacacagtcagtgtctccagccggtccagagaatacagcgcaggctgagggggatgaagaggaagaaggcgaagaggagtcttcactgatagagatcgctgaagaagccgatctaatacaggcggatagggtgatcgaagaggaagaggtcgttcggcctcagcgcagaaagaaggaggagtcaggagctgaccaagaactcgctaagatgctgctcgctatgcgtctggatcattgtggcaccggcacagccgctgggcaggaacaggcgacaggagaatggcagacgcagcgtaatcagaaaaaaaaaatgaaaaagagggtaaaagatgagctcaggaaattaaacactatgaccgccgcagaagccaatgaaatcgaagatgtctggcagctagatctgagtagcagatggcaactatattag

SEQ ID NO: 26020 - DNA, 5756 bp, Artificial Sequence
  Description of Artificial Sequence: Synthetic coding sequence
atggaagagcgacgaccacacctggacgctcgccctcgcaattctcatactaatcaccgcggacccgtggatggggaactgccccctagagcccgtaatcaggccaacaatcctcctgctaatgcgctacggggtggagcatcccaccccggtcgccaccctcgcgcaaataatcaccccgcagcttattggcaacgggaggaacgtttccgggctatgggcaggaaccctcaccagggaagaagaaatcaagagggccacgctagcgacgaggcccgtgaccagcgccatgatcaggaaaacgacaccaggtggagaaatgggaaccaggactgcagaaaccgaaggccaccttggtccaacgataactttcagcagtggaggacaccgcatcaaaagcccacagaacagccacagcaggcaaagaagctgggatacaagtttcttgagagtctactgcagaaggatccgagcgaggtggtcatcacattggctacatcgctgggcctcaaggagctcttgagtcacagcagcatgaaaagtaacttcctggagctcatctgccaagtccttagaaaagcgtgtagcagtaagatggatcggcagtctgtgctgcatgtccttggtatcttaaagaattcgaaattcctgaaagtgtgcctcccagcgtatgtggtggggatgataactgaaccgatcccagacattagaaatcagtaccccgagcacatctcaaacatcatctccctgctacaggacctggtgtctgtgtttccagcgagtagtgtacaagaaacaagtatgttggtaagtttgctcccaacaagcctaaatgcattacgggcttctggcgtggacattgaggaagagacagaaaagaacctcgagaaagtccagactattatagagcacctccaggagaagagacgagaggggacgctgcgggtcgacacttataccctggttcagcccgaggccgaagaccacgtggaaagctatcgaaccatgccgatctacccaacctataacgaggtgcaccttgacgagcgccctttcttgaggccaaatatcatcagtggtaaatacgactcaaccgccatctatctggatactcattttcgactgctacgagaagattttgtgagacctctgagagagggcatcttagaactcctccaaagcttcgaagatcagggcttgcggaagcgcaaattcgatgatatcaggatatactttgatacaagaataatcacacccatgtgctcctcttccggaatcgtctataaagttcagttcgatacaaagccccttaaattcgtgcgatggcaaaacagcaagaggcttttatacggatcattggtgtgtatgtctaaagataatttcgaaacctttctctttgcgacagttagcaaccgtgagcaggaggacctgtgccggggtatcgtccagctttgctttaatgagcagtctcaacagctgctcgctgaggttcaaccttccgatagcttcctgatggtcgagacgactgcatacttcgaggcctaccgtcatgtgctcgagggcctccaagaagtgcaggaggaagacgttcccttccagagaaatatcgtggaatgtaactcccacgtgaaggaacctagatacttactgatgggcggaaggtatgattttacgcctctcattgagaacccgtcagcaactggagagttccttcgcaacgtggaaggtcttcggcatccgaggattaacgtgctggatcccggtcagtggccatctaaggaggccttgaagttagacgatagtcaaatggaggccctgcaatttgcactcactagggagctcgccattatccaaggaccacctggtactggtaaaacttatgtgggtctgaaaattgttcaggccctgctaactaacgagtcagtctggcagatcagcctccagaagttcccgatactcgtggtatgttataccaatcacgccctggaccagttcttggaggggatttacaactgtcagaaaactagcattgtacgggtcggtggaagaagcaactccgaaattctgaaacagttcaccctgagggagctgaggaataagcgggagtttcgaaggaatctaccaatgcacttgcggcgagcctacatgagcataatgactcagatgaaagagagtgagcaggagctccatgaaggggctaaaactcttgagtgtacaatgcggggtgtcttgcgggagcaatacctccagaaatacatctccccccagcactgggagtcccttatgaatggtcccgtgcaggacagcgagtggatttgttttcagcattggaagcactccatgatgctggagtggctcggcctcggcgtcggttctttcactcagtccgtgtcccctgcaggcccagaaaacaccgcccaggccgagggcgatgaagaagaagagggagaggaggagagctcacttatagagatcgccgaggaggcggacctgatccaagctgaccgggttatcgaggaagaggaggtcgtgagacctcagagaaggaaaaaggaggaatcaggggcagaccaagagctggcaaagatgctcctggccatgagactggaccattgtggaacagggacagctgcagggcaagagcaggccaccggagagtggcaaacacagaggaatcagaagaaaaaaatgaaaaagcgtgtgaaagacgagctgagaaaactgaacacaatgactgccgcagaagcaaatgaaattgaagacgtgtggcagctggatctgtcgtcacggtggcagctctatcgcctatggctacaactgtatcaggctgatactaggcggaaaatcctatcatacgagcggcagtatcgaaccagcgcagagaggatggctgaactgagactgcaggaagacctccacatcctgaaggacgctcaggtggtcggcatgaccacaaccggggctgcaaagtatcgccagattctgcagaaggtggagccccgtatcgtgatcgttgaagaggcggcagaagtgttagaagcccacaccatagcaaccttgagcaaggcttgtcagcatcttatactgattggagaccatcaacagctgcgcccatccgccaatgtgtacgacctggctaaaaacttcaacttagaggtgagcctgttcgaaagactcgtcaaggttaatattccttttgtgaggctgaactatcaacatcgcatgtgtccagaaattgccagactgctcacccctcatatctatcaagacttagaaaatcacccatctgtactaaaatatgagaaaattaaaggcgtatcgagtaacctgttctttgtggaacacaatttcccggagcaagaaatacaagaaggcaagagtcaccagaatcagcacgaggcccatttcgtggtggaactctgcaagtacttcctctgtcaagaatacttgccttctcagatcaccatactcactacttatacaggtcagctattttgcctgagaaaactgatgccggcaaaaacttttgccggagtaagggtccatgtcgtagacaagtaccagggcgaggaaaacgacatcatcctgctctctctagtccgctcaaatcaggaggggaaggttggctttctgcaaattagcaatcggatctgcgttgcgctctctcgcgcaaagaaagggatgtactgtatcgggaacatgcagatgctcgcgaaggtccctctgtggagtaagattattcacacattgcgcgagaataatcagatcggtcccatgctgcgcctttgttgtcaaaaccacccagagactcataccctcgtgtcgaaagccagtgacttccaaaaggtgcctgagggcggttgctcattaccctgcgaatttaggctgggctgtggccacgtctgtaccagagcttgtcacccatacgattcttcccacaaagaattccagtgcatgaaaccctgtcaaaaggtcatctgtcaggaaggtcacagatgtccacttgtgtgtttccaggagtgtcagccatgccaggtcaaagtgcctaagactataccgcgatgtgggcatgaacagatggtgccctgtagcgtgccagaatctgacttctgctgccaggaaccttgcagcaagtccctgaggtgcggccaccggtgcagccacccttgcggagaagattgcgtacagttatgttccgagatggtcactattaagcttaagtgcggtcactctcaacccgtgaaatgtggtcatgtggagggacttttgtacgggggactcttggttaagtgcactacaaagtgcggcactatcttagattgtgggcacccctgccccggtagctgccactcctgctttgaaggcaggttccatgagagatgccaacaaccctgtaagcggctactgatttgttcacataagtgtcaggaaccatgcattggggagtgtcctccatgtcagcgcacgtgtcagaacaggtgcgtccacagtcaatgtaaaaaaaaatgcggtgagctctgttctccttgcgtcgagccatgcgtctggcgctgccagcattatcagtgcactaaattgtgttccgagccctgcaataggcccccttgctacgtcccgtgcaccaagcttctggtgtgtggtcacccgtgtatcgggctctgtggcgagccctgtcctaaaaaatgtcgtatctgccatatggatgaagtgacacagatcttctttgggtttgaggatgaaccggatgcgaggtttgtccaactcgaggactgttctcacattttcgaggtgcaggccctagatcggtacatgaacgagcaaaaagatgacgaggtagctattcgcctgaaggtgtgtcccatttgccaggttcccatcaggaaaaacctaaggtacggcacttctatcaaacagaggctagaggagatcgagataatcaaggagaagattcagggtagtgcaggtgaaattgccacatcacaggagcgcctgaaggctctgttggagaggaagagcctactccatcagctgcttcccgaggatttcctgatgcttaaggaaaagttggcccagaaaaacctctccgtgaaggacctgggactggtcgagaattatattagtttctacgaccacctggcttctctgtgggactctctcaagaagatgcatgtgctggaagaaaagcgcgttcgcacccgcttggaacaggtgcatgaatggctggccaagaaacggctgtcattcacgtcacaggaactaagtgatttgcgcagcgagattcagcgacttacttacctcgtcaacctcctgacccgctataagatcgccgagaaaaaagtcaaggattcaattgccgtcgaagtgtacagcgtgcagaatatcctggagaaaacttgcaagttcacccaggaggacgagcaactggtgcaggaaaaaatggaggcgttaaaggcgacactcccatgctccggcttaggcatctccgaggaagagagagtgcagatcgtgagtgcgatcggataccccagagggcactggttcaaatgtaggaacggacacatatatgttatcggtgactgcggcggagcgatggaacggggaacatgccccgattgcaaggaagtcattggaggaacgaatcatactctcgagcgtagtaatcaactggccagtgaaatggatggggctcagcatgctgcatggagtgacactgccaacaacctcatgaacttcgaggagatccagggcatgatgta

SEQ ID NO: 26021 - DNA, 3813 bp, Artificial Sequence
  Description of Artificial Sequence: Synthetic coding sequence
atggaagagagacggccacatcttgacgccaggccacgaaattctcatacaaatcaccgtggccctgtggatggtgaactcccaccaagagccagaaaccaggcaaacaacccaccagctaacgctcttaggggcggtgcttcccacccaggccgacaccctcgggctaacaaccaccctgctgcctactggcagcgcgaggaacgattccgcgcaatggggagaaatccacaccagggcaggaggaaccaggaaggacatgccagcgacgaagccagagaccagagacacgatcaggagaacgatacccgatggagaaacgggaatcaggactgtaggaacaggcgtccaccctggagcaacgacaattttcaacagtggcgcactcctcaccagaagccaaccgaacagccccaacaggcaaagaaacttggctacaagtttcttgagtccttgcttcagaaggacccatccgaggttgtaataaccctggctacctccctgggtcttaaggagcttctcagtcattcctctatgaagtccaattttctggagctgatttgccaggtccttagaaaggcatgctccagtaaaatggaccggcagagcgtcttacatgtgctggggatcttgaaaaactcaaagtttctgaaagtgtgtctgccagcttacgttgtcggcatgataactgagcctatccctgatatccggaatcagtaccctgagcacattagcaatattatctctttactacaggatctggtgtcagtgttccctgcctcatcagtgcaggagacgtccatgttggtgagcctcctccctacgagcctcaatgcccttcgagcctcaggagtcgacattgaagaggaaacagagaagaacctggaaaaggtccaaactatcattgagcacctgcaggagaaacggagggaggggacactgcgtgtggacacctatacactggtgcagcctgaggctgaggatcatgttgaatcttaccggaccatgccaatctacccaacctataatgaggtgcatcttgatgaaagacccttcttgagaccaaacatcatttctgggaagtacgacagcaccgctatctacctggacacacatttcaggctgcttagggaggacttcgtccgccctttaagggaaggcattttagaactgctgcagtcctttgaggaccaaggcctgcgcaaacggaaatttgatgatatcaggatatacttcgatactagaatcattacacctatgtgctcgtcctctgggatagtgtataaagtgcaattcgacactaagccgctgaaattcgtgaggtggcagaactctaaaaggttgttatacggatccctggtttgcatgagcaaggataacttcgaaacattcctcttcgcaaccgtctcaaatagggagcaggaagacctctgtcggggtattgtgcagctctgttttaacgagcagagtcagcagctgcttgccgaagttcagcctagtgactccttccttatggtggagactactgcttatttcgaagcttacaggcacgtcctggaaggtctccaggaggttcaggaagaggacgttcccttccagaggaatattgtggaatgtaattcccacgtgaaggagcctcgttacctgctcatggggggacgctatgacttcacaccactgatagaaaacccctcagcaaccggcgaatttctgcgaaatgtcgagggcctgcggcaccctcgcataaacgttctggacccgggtcagtggccgagcaaggaggccctgaaattagatgactctcagatggaggctctccagtttgctctgacgagagaactggccattattcaaggtccacccggaaccgggaagacatatgtcggccttaagatagtacaggcactactcactaacgagtcagtctggcagattagtctccagaagtttccaatactcgttgtttgttatactaatcacgccctggatcagttcctggaggggatatacaattgccagaagacctcaatagttcgcgtgggcggaaggtcaaattccgaaatcttgaaacagttcacgctaagggaattgcgaaacaagcgcgagtttcgcagaaatctgcccatgcatttacggagggcttatatgagtatcatgacacagatgaaagagtcggagcaggagctccacgagggggcaaagaccttggagtgcacaatgcgtggggtcctgcgtgagcagtacctccagaagtacatcagcccacagcactgggagtctttgatgaatggccctgtacaggattccgaatggatttgcttccaacactggaaacactcaatgatgctcgagtggctgggcctgggcgtggggtcgtttactcagtccgtgagccctgccggtccagagaacacggcgcaggccgaaggggacgaagaggaggaaggtgaagaagagtccagcttaatcgagattgctgaggaagccgatttaatccaggctgaccgtgttatcgaggaagaagaagttgtcaggccccaacgtcggaagaaagaggaatccggggctgaccaagaacttgcgaagatgctcttggcaatgcggcttgaccattgcggaaccggaaccgcggctggacaggaacaggctaccggggaatggcagacccaaagaaaccagaagaagaagatgaagaaacgcgtaaaggatgagctaagaaagctgaatactatgactgcggctgaagcaaacgagattgaggacgtgtggcagctggatctgagcagcaggtggcagctctacagactctggctgcagctctatcaggccgatactagacggaaaatcttgagttacgaaaggcagtaccggacctccgctgaacggatggccgagttacgccttcaggaagatctccacattctgaaggatgctcaggtagtgggtatgacaacgaccggcgctgctaagtacaggcagatcctgcagaaggtggagcctaggattgtgattgtggaggaggccgcagaagtattagaagcccacactattgccaccttaagcaaggcatgccagcacctaatcctcatcggagaccaccagcaactgcggccatcagccaatgtgtatgacctggccaaaaatttcaacttagaagtgtctctttttgaaaggctggtgaaagttaatattccatttgtaagacttaactaccagcaccggatgtgtcccgaaattgctcggcttctgacaccccatatttaccaggacctcgaaaatcacccaagcgtgttgaagtacgaaaagattaaggccaaatctaatagctgccgggctctggcaaccggcatgaggcgcaagcataagatctccggaatgattctgagcttcttcaagctgacaattcgctctgctcgcttccagcttctactgtcaggaagctggaccacagcttccttccccttctccaggtcccgttttgcagtgctcatctgtcgggacaataagcgaatgccagcggtaaaaccggtgagcaccaacacgggttcgcatggcctgcagatgcctggtgcacttatgggtgaaaccttccagaaggggtcgacctccagggacgcagcagcttgtctactcagctccctggtcaataagattccaccaaggtcactaacctgggcgtccgactgttgtatcagcttcagctctgcgtcgagttgtcgcaccgcgtatacatcattctcgattttctcaatacttagtagaaatctgagaatgacgagtcagtgggagaaaatcaaacgaatttacaagtag

SEQ ID NO: 26022 - DNA, 5756 bp, Artificial Sequence
  Description of Artificial Sequence: Synthetic coding sequence
atggaagaacgtcggcctcatctagatgcccgtcctaggaactcacatactaaccacagaggccctgttgacggagaacttcctcccagggctcggaaccaggcaaacaaccctcccgctaatgcattacgtggcggtgccagccaccccggacgccatccccgtgcgaacaaccacccagctgcgtactggcaacgtgaagagcgattccgcgcaatgggcaggaatccacaccaggggcgtaggaaccaggaggggcacgcttcagatgaggctagggatcagaggcacgatcaagagaacgacactcggtggagaaatggaaatcaggattgccgcaaccgcaggccaccctggtcaaacgataacttccaacagtggcgaaccccgcatcagaaaccgactgagcagcctcaacaagcaaaaaagcttggctacaagtttctggagagcttactccagaaagaccctagtgaggtcgtcataacattggccaccagtctgggactcaaggagctcctgtcccatagctccatgaagagcaatttcctggagctgatctgccaggtgctgcgcaaggcatgctcttccaagatggatcgacagagcgtgcttcatgtgctgggcattctcaagaatagtaagttcctcaaggtttgtctccctgcctatgtggtaggcatgattacagaacccatccctgacatccgtaatcagtatccggaacacatcagcaatatcatcagtttgctacaggacctcgtgtccgtgttccccgcttcaagcgtgcaggagacctctatgctcgttagcctgctgccaaccagtctcaatgccctgcgcgcatctggcgttgacatagaagaggaaacagagaaaaatcttgagaaggtccagaccataatcgagcatctgcaggagaagagacgcgaaggaacactgcgcgtcgatacttatactctggtgcagccagaagctgaagaccacgttgagagttacaggacaatgcccatctacccaacgtataatgaagtccaccttgatgagagaccctttctcaggccaaatattatcagcggcaagtacgactcaaccgcaatttatctggatacccactttcgtcttctgcgggaagattttgtgcggcctttgcgcgagggcatcctggaactactgcaaagcttcgaggatcagggccttcggaaacgtaaattcgacgacatcaggatttactttgacacacggatcattaccccgatgtgcagctccagtggtatcgtttacaaagtgcagtttgataccaagccactgaaattcgtgagatggcaaaacagtaagcgactattgtacggctccctcgtgtgcatgagcaaagataatttcgagacattcctgtttgcaaccgtctcaaatcgagaacaagaagatctctgcagaggcatcgtccaactctgtttcaacgagcaatcccagcaactgttagcagaggtgcaacctagtgactcctttttaatggtggagacaaccgcttatttcgaggcctataggcatgtgctggaagggctgcaagaggtgcaggaagaggatgttcctttccagaggaatatagttgaatgtaactctcacgtgaaggagcccagatacctgctgatgggtggtcgctatgactttacccccctgatcgaaaaccccagcgcaactggcgaatttctacggaatgtggaaggcctgcgtcatccgcgtattaatgtcctggatcccggacagtggccctccaaagaagccttgaaacttgacgatagccagatggaggctttgcaatttgcactaacccgtgagttggccatcatacaaggaccaccagggactgggaaaacatacgtgggccttaagattgtccaagcacttctgacaaatgaatccgtgtggcagatctccttgcaaaaattccctatactggtggtgtgctacacaaaccacgcattggatcagttcttagagggaatctataactgtcagaaaacctcaatcgttcgtgttgggggtaggtccaactctgagatcctgaaacagttcacgctgcgggaactgcgtaataaacgggaatttaggaggaacttgcccatgcacctgcgcagggcatatatgagcattatgacgcagatgaaagagtccgagcaagagctccatgagggggcaaaaaccctcgagtgcactatgagaggggtactcagagagcagtatctccagaagtacatctctcctcagcattgggaatccctcatgaatggtccagtgcaagactccgagtggatttgctttcagcattggaagcatagcatgatgctcgaatggctaggcttgggcgtgggctcctttacacaaagtgtttcgccagcaggacccgagaacaccgctcaggccgaaggagacgaagaagaggaaggggaagaagagtcctctctgatcgagatcgccgaggaagctgacctcattcaagccgacagggtgatcgaagaggaagaagtcgtgagaccccagaggcgcaaaaaggaggagtcaggcgctgaccaagagttggccaaaatgttgctggctatgcgcctggaccactgcggcacaggcacagctgccggacaggagcaggcgaccggggagtggcagactcagcggaatcagaagaaaaagatgaaaaaaagggtgaaagacgaactacgcaagcttaacaccatgactgccgctgaggcaaatgagatcgaagacgtctggcagctcgatctttcatcacgctggcagctctatcggctgtggctacagttgtatcaggcagacacacggaggaaaatcctgagctacgaaagacagtataggacctcagcggaaaggatggcagaactgcgtttgcaagaggacctgcatatcctgaaggacgcccaggtggtggggatgaccaccacgggcgctgcgaaatacaggcagattttacagaaagtagagccccgaatcgtaatcgttgaggaggcagccgaggtgcttgaagcccacacaattgccacgctgagcaaagcgtgccagcacctgatcttgatcggtgatcatcagcagctgaggccgagcgcaaacgtctatgacctggccaaaaactttaatctggaggtttccttattcgaacgccttgtcaaagtcaacatcccattcgtgagactgaattatcaacaccggatgtgtccggagatagcccgtctgctgactccccacatctaccaagacctggagaatcacccaagcgtgctgaagtatgagaagatcaagggagtgtcctctaaccttttcttcgtcgagcataactttccagagcaggagatccaggaggggaaatcccaccagaaccaacacgaagctcactttgtggtcgaactgtgtaagtattttctgtgccaggagtaccttccgagtcaaattacaatccttacaacttatactggccagctattctgcctccgcaagctgatgccggctaagaccttcgcaggagtcagggtccacgtggtcgataaataccaaggagaggaaaacgatattatactcctctccctagtgagaagtaaccaggaggggaaagtgggatttctacagatcagtaaccgcatctgtgttgccctgtcacgtgccaagaagggtatgtattgtattgggaacatgcagatgctggcaaaagtgccactttggtctaagatcatccacacgctgcgggagaacaatcagatcggtccaatgctccgcttatgttgccaaaaccatccagaaactcatacacttgttagcaaagcttcagattttcagaaggtaccagaagggggatgctccttaccttgcgaatttcggctcgggtgtggacacgtgtgcactcgggcttgccacccttatgattcatcccataaggagttccagtgcatgaagccttgtcaaaaggtcatttgtcaggagggccaccggtgcccccttgtgtgctttcaagagtgccaaccctgtcaggtgaaggtaccgaagaccattcctcgctgtgggcacgagcagatggtgccctgctccgtgcccgaaagcgatttttgttgtcaggaaccgtgctccaaatctctccggtgtggccaccgctgtagtcacccctgtggagaggattgtgttcagctgtgttcagaaatggttaccattaaactgaaatgtgggcacagtcaaccagtgaagtgcggacatgtcgaaggattactctacggcggattgctagtgaaatgtaccacaaagtgtggaacaattttagactgtgggcacccgtgccctggatcatgccacagctgttttgaaggacgctttcacgagcgctgtcagcagccctgtaagcggctgctcatctgctcccataaatgtcaggagccctgcattggggagtgccctccttgtcagagaacgtgccaaaatcggtgtgtgcatagtcagtgtaagaaaaaatgtggtgaactgtgcagcccttgtgtcgagccttgcgtatggcgttgtcagcactaccagtgcaccaagctgtgcagcgaaccttgcaatcgaccaccctgttatgtaccctgcaccaagcttttggtgtgcggacacccatgcattgggctgtgtggagagccatgtcccaagaaatgcaggatatgtcacatggacgaggtgacccaaatcttctttggattcgaggatgaacctgatgcccgattcgtccaactggaggattgcagccacatttttgaagtccaagccctagatcgctacatgaatgagcagaaggacgatgaagtggccatacggctgaaggtgtgtccgatatgccaggtgccaataaggaaaaatctgaggtatggcacttctataaagcagagactggaagagattgaaattattaaagagaaaatccagggtagcgccggtgagatcgctacttcccaggaaagactcaaagctctgctggagaggaaaagtcttttgcatcagctcttgccagaggattttctgatgttgaaggaaaagctggcccagaaaaacctgagcgtgaaggatctcggcctggttgagaattacatatccttctacgaccatctggccagtctgtgggactccctgaagaaaatgcatgtactggaagagaaacgggtccgcaccagactggaacaggtgcacgagtggctggcaaaaaagcgactgtcattcacctctcaagaactgtccgatcttagatcagagatacagcgcctgacatatctggtgaacctgctcacaagatacaaaattgcagaaaaaaaagtgaaggattccatcgcggtagaggtttattctgtgcagaacatcctagaaaaaacatgcaagtttacccaggaggacgaacagctggtccaggagaagatggaagccctcaaggccacgctgccgtgtagtggcctcggcatctctgaggaagaacgggttcaaatagtgtccgcgattggctatccaaggggacattggttcaaatgccggaacggacatatttacgtcattggggattgtgggggtgcgatggagagaggcacttgccccgactgcaaggaagtcataggcggtactaaccatacgttggagaggtccaaccagctggcctctgagatggacggagcacagcatgcggcttggtcggacacagccaacaatctcatgaactttgaagaaatacagggcatgatgta

SEQ ID NO: 26023 - DNA, 2748 bp, Artificial Sequence
  Description of Artificial Sequence: Synthetic coding sequence
atggaggaaagaagacctcacctggacgctcgccctaggaatagccataccaaccaccgtggtccggtcgacggagagctgccacccagggctaggaaccaagccaacaaccctccggctaatgctttacgtggaggcgctagtcacccaggcaggcacccacgagccaacaatcatccagccgcttattggcagcgcgaagaaaggtttagagcgatgggccgtaatccacatcaaggcaggaggaatcaagagggtcatgcttcagatgaggcaagagatcaaagacacgaccaggaaaacgacacgagatggaggaatggaaaccaagactgtcgaaatagaaggcctccctggagcaacgacaattttcagcagtggcgaacccctcaccaaaaaccaactgagcagccgcagcaggccaagaaactgggctataagttccttgaaagtcttctgcaaaaggatccctctgaggtcgttatcacactagctaccagtctggggctaaaggagctgctgagtcactctagtatgaagagtaattttttggaactgatctgccaggtcctgcgtaaggcatgcagtagtaagatggacaggcaatctgtcctgcatgtcttgggcatcctgaaaaattccaagttcctgaaggtgtgtctgccggcatatgtagtaggtatgatcacagagcctatccctgatatccggaaccagtatcccgaacacatctctaatattattagcctgttacaagatttagtgtccgtgttccccgcatcatcagtgcaagaaacttctatgcttgtctccctcctacccacatctcttaacgccctgcgcgcttcaggagtggacatcgaggaagagaccgaaaagaatctggagaaggtgcagacgattatcgagcatctgcaggagaagagacgggagggaacccttcgggttgacacctatacgctcgtgcagcccgaagccgaggaccacgtcgagtcataccgcactatgcctatatatccgacatataacgaagttcaccttgacgagaggccctttcttcgtcctaacatcattagtggaaagtatgattcaaccgccatctatcttgacacccatttccgtcttctgcgagaggactttgtcaggcccttaagggagggcatcctggaactcctccagagttttgaggaccaggggctccggaagagaaaatttgatgatatacggatatactttgacacccggatcataacccccatgtgctcctcatcgggcattgtctataaagtgcagttcgatactaagcctcttaagttcgtgcggtggcagaacagtaagagactgctttacggctcattagtgtgtatgtctaaggataacttcgagacttttctgtttgctaccgtctcgaaccgcgagcaggaggacctgtgtcgcggaatcgtgcagctttgcttcaacgaacagtctcagcagctgctagctgaagtgcagcccagcgattcctttctgatggttgaaactacagcctattttgaggcctacagacatgtgctggaaggcctacaagaggtacaggaagaagacgtcccattccaacgaaatattgtcgagtgcaatagccacgttaaggaaccgaggtatcttctgatggggggtcgctacgacttcacaccactgattgagaacccgtccgcgactggcgagttcttgcggaacgtcgaaggccttcgccaccctcgtattaacgtgctcgatccaggtcaatggccctccaaagaagcgctgaaattagacgactcccaaatggaggctctgcagttcgcattgacccgggaactggcgatcattcagggccctcccggaaccggtaagacatatgttggccttaagatcgtccaggctctactaacaaatgaaagtgtgtggcagattagtctgcaaaaatttcctatccttgttgtttgttacacaaatcacgccctagaccagtttctggaaggcatctataactgccaaaagacaagcattgtccgtgtggggggacgaagtaatagtgagatactcaagcaatttaccctgagggagctgagaaataaacgtgagttccgtagaaacctgccaatgcatctgagacgtgcctacatgagtatcatgactcagatgaaagaaagtgagcaagagctccatgagggggctaaaactcttgagtgcactatgcgcggtgtgctcagagaacagtatctccagaaatacatctccccgcagcattgggagtccttaatgaatggaccggtgcaggacagtgaatggatctgttttcagcactggaaacacagtatgatgctcgagtggctgggcctcggagtcggttctttcacgcagagcgtctcccccgcagggccagagaacaccgcccaggctgagggggatgaagaggaagagggtgaggaggagtccagcttgatcgagattgctgaagaggctgacctgattcaggcagatagggttatagaagaggaggaggtggtccgacctcagcggagaaaaaaagaggagtccggcgcagatcaggaactcgctaagatgctcctggccatgcgactggatcactgcgggacaggaactgccgctgggcaggagcaagctacaggcgagtggcagacccagcgaaatcagaagaagaaaatgaaaaaacgggaaaaggaagaaaaaaaagagagggagaaacgcaggaaaaaaaagtag

SEQ ID NO: 26024 - DNA, 2124 bp, Artificial Sequence
  Description of Artificial Sequence: Synthetic coding sequence
tcaaaaatggacagacaatccgtgctgcacgttctgggaatactcaagaatagtaagtttcttaaggtttgcttgcctgcttatgtggtcggtatgatcaccgaacctattcctgacatacgtaaccaataccccgagcacatttccaatatcatctcactgctgcaggatctggtctctgtatttcccgctagttccgtgcaagagacctctatgcttgtgtccttgctgcccacctcactgaacgcccttcgcgcaagtggggtggatattgaggaggagacggagaaaaacctcgagaaagtacagacgataatcgaacacctccaggaaaagcgacgcgagggcactttaagagtcgacacatacaccttagtgcagcctgaggccgaggaccatgtggaaagctaccggaccatgcctatttaccccacatataatgaggtgcacctcgacgagcgtcctttcctgaggccaaacattatttccggaaaatacgactccaccgccatctacttggatacccatttcaggttattgagagaagattttgttcggcctcttagagagggcatccttgagctgttacagtcatttgaggatcaagggctgcgcaagcgcaaattcgacgacatccggatctactttgacacccgcataatcactccaatgtgttctagcagcggaatcgtgtacaaggtgcagttcgacaccaagcccttgaagttcgttaggtggcagaattcaaaacgcctactctacggcagcctggtctgcatgagtaaggacaactttgaaacctttttgtttgctacagtgagtaatcgcgaacaggaagacctgtgccgcggaatcgtgcagttgtgttttaacgagcagtcacaacagctgctggctgaggtccagccctccgacagcttccttatggttgaaaccactgcctatttcgaagcctatcgccacgtcctggaaggcctgcaagaggtgcaggaagaggatgtgcccttccaaaggaacattgtggagtgtaattcacacgtgaaggagcctaggtacctgcttatgggcggaaggtacgattttacaccactgatcgaaaatccatcggctaccggagagtttctgcgtaatgtggaggggctgcgccacccaaggattaatgtcctcgatcctggacagtggccaagcaaggaggccctcaagctggacgatagccaaatggaggcactgcagtttgcccttaccagggaactggcgattatacaaggtccacccggaacaggcaaaacgtatgtggggctgaagatcgtgcaagccctgctgactaatgagtccgtttggcagatatcccttcagaaatttcccattctagtagtctgctatacgaaccacgcattagaccagtttttagaaggtatctacaactgtcagaaaacaagtattgtccgcgtcggcggaaggagcaactctgagatcttaaaacagttcactctgcgggaattacgtaataagagagagttccggaggaatcttcccatgcatctacgcagggcctacatgtccattatgactcagatgaaggagtctgagcaagaactgcatgagggcgctaagaccctcgaatgcactatgagaggggtgttgcgggagcagtacctccagaaatacataagcccacagcattgggaatcactaatgaacgggcctgtgcaggattccgagtggatttgcttccagcactggaagcacagcatgatgctggagtggcttggactcggcgttggtagcttcactcagtcggtctcccctgccggtcccgagaacacagcgcaggctgagggcgatgaggaggaggagggggaagaagagtccagcctgatcgaaatcgccgaggaggccgatctgatccaagccgatcgagtcatcgaggaagaggaggtcgtccgtccccagcggaggaaaaaggaggagtccggggctgaccaggagcttgctaaaatgctgttggccatgcggctcgatcattgcggtacggggactgcagccggacaggaacaggctaccggggaatggcagactgtaccatgtctcgtgctgatgagtgccgatcctgcccagccctag

SEQ ID NO: 26025 - DNA, 186 bp, Artificial Sequence
  Description of Artificial Sequence: Synthetic coding sequence
atggaagagcggcgacctcatctagatgccaggccaagaaactctcatacaaatcatagaggcccagtagacggtgaactacctccaagagcagaaattatgcctttacattcttccctgggagaccggtccaaaactttgtcgcagaagaaaaagtctttcttcctggtgttggccccaacttag

SEQ ID NO: 26026 - DNA, 963 bp, Artificial Sequence
  Description of Artificial Sequence: Synthetic coding sequence
atgagtactaagaacttccgcgtgtctgacggcgactggatttgcccagataagaaatgtggcaatgtaaatttcgcaagacggactagttgtaatagatgcggtcgtgagaagaccaccgaggccaagatgatgaaggccggaggcaccgagattgggaagacattggccgaaaaaagccgcggtttgttcagcgctaacgattggcagtgcaaaacatgttcaaatgtcaattgggcgaggcgaagcgagtgcaacatgtgtaatactcccaaatacgccaagttggaggagagaaccggctatggcggaggctttaacgaacgagagaacgtggaatacatcgagagggaggaatccgatggtgagtatgatgagttcggacgcaaaaagaaaaagtaccggggaaaggctgtggggccagctagtatcctaaaggaagtggaagacaaggaatctgaaggggaagaggaggatgaggacgaagatctcagtaagtataagctggacgaggatgaggatgaggatgatgccgacctctcaaaatacaatcttgatgcgtccgaagaagaggattccaacaagaaaaaaagcaatcgtaggagccgaagcaaaagccggtcctcccatagcaggagctcttcccgttccagctcacccagctcaagccgctcccgatccagatcacggtcaagatccagttcctccagtcagtctcgcagccgctcatcctcccgcgaaaggagccggtccagaggaagtaagagcaggtcatcatctaggtcccacagggggagttcatccccacgcaaacgcagctactccagttcctcaagctcaccggagcggaaccgcaagagatcgaggagtaggtcttcgtcaagcggtgaccgcaagaaacgcagaaccaggagtcgtagtccggaatcccaagtcatcggagaaaataccaagcaaccttag

SEQ ID NO: 26027 - DNA, 993 bp, Artificial Sequence
  Description of Artificial Sequence: Synthetic coding sequence
atgagcacaaaaaatttccgcgtatccgatggcgactggatctgccccgacaagaaatgcgggaatgtgaacttcgcaaggagaacctcctgtaaccgctgcggcagagaaaaaactacagaggccaagatgatgaaggccggagggactgagattggtaagactttagcagaaaaaagccgtggcctgtttagcgccaatgattggcaatgcaagacgtgttctaatgtcaattgggcacggaggagtgaatgcaatatgtgcaatacaccaaagtacgctaaattggaagagagaacgggatacgggggtggtttcaacgaacgagagaatgtagagtatattgagagagaggaatcggatggcgagtacgacgagtttggaaggaaaaagaaaaagtatagagggaaggccgtggggccagccagtatcctaaaagaagttgaggacaaagagtcagaaggcgaggaggaggatgaggatgaagaccttagtaaatacaaactggatgaggatgaagatgaagacgacgcagatcttagtaaatataatctcgatgctagcgaggaggaagattctaacaagaagaagtcaaaccggagatcccgatcgaaatcacgttcatcacacagtagatcctcctcaagaagctctagtccgtcttcctcaagatctcgctccagatctcgaagtcgatcatcctcttcgtcacagtcccgctccagaagctcatctcgggaacggagcagatctcgcggatccaagtcacgctcttccagcagatctcataggggctccagctcacccagaaaacggagctacagcagcagttcttccagtcccgaaaggaaccgaaaacgaagcagaagccgctctagcagtagcggtgaccgaaaaaagagacgaacaagatctcgtagcccagagaggcggcacaggtcctcttcggggtcatcacattccggttctagaagtagtagtaaaaaaaagtag

SEQ ID NO: 26028 - DNA, 1458 bp, Artificial Sequence
  Description of Artificial Sequence: Synthetic coding sequence
atgctggagcgtcttaaggccccatggtctgccgcactgcagaggaaatattttgatctgggtatctggactgctcctatatcacccatggccctgaccatgctgaacgggctgcttatcaaagacagcagcccacctatgctgcttcaccaggtcaacaaaactgcccagcttgatactttcaactatcagtcatgtttcatgcagtccgtctttgaccacttcccagagatactgttcatccacagaacatataaccccagggggaaggttttgtatactttcctggttgacggtccacgagtgcagcttgaaggccatctggccagggccgtatattttgcgatcccagccaaagaagacactgagggtctggcccagatgtttcaggtgttcaaaaaattcaatccagcatgggagagggtgtgtacgatccttgtggatccccatttcctgccactccctatcctggctatggaatttcccacagcagaggtcctgttgtccgcattccacatatgcaagtttctgcaggccaagttctaccagttgtcccttgaacgccctgtggaaagactgctgctgacctcgttgcaatcaaccatgtgctctgccactgcagggaacctgcgaaaactgtacacccttttgagtaactgtatcccccctgccaagctgccagagttgcatagtcactggctgctgaatgaccgcatatggctggcccaccgctggaggtcacgtgccgagagctcccactacttccagtctcttgaggtcacaacgcatatcctttcacagttctttggtaccacccccagcgagaagcaaggcatggcctccctgtttagatacatgcagcagaactcagcggacaaagccaactttaaccagggcctgtgcgctcaaaataatcatgcaccctctgacacaattcctgagtcacctaaattagagcaactagtcgaatcccatatccagcacagcttgaacgctatctgcactggccctgccgcacagctgtgtctcggggagttagctgttgtccagaaaagcacacatctcattggctcagggtctgaaaaaatgaatatacagatcctagaagatacccataaggtccagccccagcctcccgcaagctgctcatgttatttcaaccaggccttccatctcccttgtcgtcacattctcgctatgctatcagctaggaggcaggtgttgcaaccagatatgctcccagcccagtggactgctggctgtgccaccagccttgacagcattttgggttctaaatggtccgaaactctggacaaacatctcgcggtcactcatctgacggaagaggttgggcagttattgcaacactgcacaaaagaagaattcgaacggaggtactctactctcagagagttagcagacagctggattggtccctacgaacaagtgcaactgtag

SEQ ID NO: 26029 - DNA, 1458 bp, Artificial Sequence
  Description of Artificial Sequence: Synthetic coding sequence
atgctcgagcggctcaaggccccatggagcgctgccttgcagaggaaatactttgaccttggtatttggactgcccctatcagtcccatggcccttacaatgctgaacggcctgttgattaaagactcctccccacctatgcttctccaccaagttaataaaactgcccaactcgatacatttaactatcaatcatgttttatgcaaagtgtgtttgaccacttccccgaaatattgttcatccacaggacctataacccaagaggtaaagtgctctacacttttttggttgatggccctcgtgtccagctcgaaggccacctcgctcgggctgtctacttcgcgatccccgcaaaggaggacactgaaggacttgcccaaatgtttcaagtcttcaagaaattcaaccctgcctgggaacgcgtgtgcacaatcctcgtggaccctcatttcctcccccttccaattttggccatggagttcccaacagctgaggtactgcttagcgcctttcatatttgtaaatttctccaagctaagttttatcaattgagcctggagagacctgtagaaagactgcttctcacatcgctacagtcaaccatgtgctcagctacagcaggcaacctccgcaaattgtatactttactatccaactgtattccgcctgcaaaactaccagagcttcacagccactggttgcttaacgaccgtatatggctggctcacaggtggagatccagagcagagtcttcccactatttccagtccttggaggtcactacccacattctgtcacagttctttggcacaacgccatccgagaaacagggaatggcgtctctgttccggtacatgcagcagaatagtgcggataaagcgaatttcaaccagggcctgtgcgctcagaacaatcacgcaccgagtgatactatcccagaatcccctaagctggagcagctggtcgagtcccacatacagcactctcttaacgcgatttgcacagggccagccgcacaactctgcttaggcgagctcgccgtggtccagaaatcaacacacctgattggcagtgggagtgaaaagatgaatatacagatacttgaggacacccataaggtccagccccagcctcccgctagctgcagctgctacttcaaccaagcattccaccttccatgtaggcacatcctagcaatgctgtcagcaagaagacaggtcctgcagcctgacatgctgcccgctcagtggactgcaggctgcgcaacatccttggatagcattctcggtagtaaatggtcagagacattagacaagcaccttgccgttacccacctgactgaggaggtgggccagctgctccaacattgtaccaaggaggaatttgaacgacgttactccaccctgcgggagttggcagacagctggatcggtccttatgagcaggtgcagctatag

SEQ ID NO: 26030 - DNA, 423 bp, Artificial Sequence
  Description of Artificial Sequence: Synthetic coding sequence
atggctgtcgtcctgccagcagtggtggaggagctcttatccgagatggctgcagccgtgcaggaatccgcaaggattcctgacgagtatctcctctcactgaagtttcttttcggaagctctgctactcaggctttggacctggtcgaccgccagagtatcactctaatttcatcaccaagtggcaggcgcgtgtaccaggttctgggttcttcctccaagacttatacttgcctggctagttgtcattactgctcatgtcctgccttcgccttcagtgtcctgagaaagtcagattccattctgtgcaaacacctgctggccgtgtacttaagccaggtgatgagaacgtgtcaacaattgtccgtctcagataaacagcttacggacatcctcttgatggaaaagaaacaagaggcctag

SEQ ID NO: 26031 - DNA, 423 bp, Artificial Sequence
  Description of Artificial Sequence: Synthetic coding sequence
atggccgttgttctgcccgcagtggtcgaggagttgctgtctgaaatggccgctgccgtccaggaaagtgctaggattcccgacgagtatctgctgagtctgaagtttctgttcggctcttcagcgacccaggccctggatctcgtcgacagacagagcatcaccttgatatcttccccctccggccgaagggtataccaagtgctgggtagctcatccaagacttatacttgcctagcaagctgccattactgttcctgtcctgctttcgcgttcagcgtgctgaggaagtccgattcgattctctgcaagcacctgctggctgtatatctgagtcaggtgatgaggacatgccagcaactctctgtgtctgataagcaactgacagacattctcttgatggaaaagaagcaggaggcatag

SEQ ID NO: 26032 - DNA, 1230 bp, Artificial Sequence
  Description of Artificial Sequence: Synthetic coding sequence
atgattgacctgtggttgtactcttaccagcgtctactccagaccattgctgttctggaagctcagcgaagccaggccgtgcaggatctcgaatctctgggaaggcaccaacgcgaggctttgaagaaccccattggctttgtggaaaagttacagaagaaggcggacatcgggctcccctatccccagcgcgtggtgcagctgcctgaaattgtgtgggatcagtacacacattccctgggaaattttgaaagagaattcaagaatagaaagcgccacactcggagggttaaactggtgtttgacaaggttggcctgccagccaggccaaagtcgccgctggaccccaaaaaggacggcgaatctttgtcatactctatgctgcctctcagcgatggccctgaaggatcttccagtcgaccgcagatgatacggggtcggttatgtgacgatacaaaacctgaaacttttaaccagctctggactgtagaggagcagaagaaattagagcagctgctgattaaatatcctccggaagaggtcgaaagccgtcgttggcagaaaatagcagacgaattgggcaatagaaccgctaagcaggtggcaagtagagtgcagaagtactttatcaaattaaccaaggccggaatccccgtccctggcagaacccccaatctctatatctacagtaagaagtccagtactagtcggagacagcaccctctgaacaagcatctgtttaagccctcaactttcatgacttcccacgagccgcctgtgtacatggatgaagacgatgacaggtcatgttttcattcccacatgaatacggccgtggaagacgcttctgatgatgaatctatcccgatcatgtatcgtaaccttccggaatacaaagaactcctgcaatttaagaagctgaagaaacagaagctccagcagatgcaagccgagtccggcttcgtgcagcacgtggggtttaagtgcgacaactgcggcattgaacccatacagggcgtgcggtggcattgccaggattgtcctcctgagatgtcgctggatttctgtgactcctgctccgactgtcttcatgaaaccgatattcataaagaggatcaccagctggagccgatctacagatcggaaacgttcctagatagggactattgtgtgtcccaggggacctcctataactacttggatcccaactattttccagccaatcgatag

SEQ ID NO: 26033 - DNA, 2712 bp, Artificial Sequence
  Description of Artificial Sequence: Synthetic coding sequence
atggcagcctccagatctacccgagttaccaggtccactgtaggtttaaacggattagatgagtcattttgcgggagaacgctgaggaaccgaagcattgcccacccagaggagatctcctcaaattcccaagtcaggtcaaggtcccctaagaagcgcccagaacctgttccaatccaaaagggtaacaataatggaaggaccacagatctgaagcaacagagcacccgcgagtcctgggtgtcaccacgtaaaagaggattgtcaagttcagagaaagataacatcgaaaggcaggccattgaaaactgtgaaagacggcagaccgaaccggtaagccctgtgctaaaaaggatcaagagatgccttcgcagtgaggcacctaattctagtgaagaggactcccctatcaagagcgataaggaatctgtggaacaaaggtcgacagtagtcgataatgatgcagattttcaaggtacgaaacgggcatgccgctgcttgatactggacgactgtgaaaaaagggagatcaaaaaagtcaacgttagcgaagaagggcctctcaattctgctgtagtcgaagagatcaccggatatcttgctgtcaatggagtcgacgattcagattccgccgttatcaattgcgacgattgccagccagatggcaataccaagcagaacagcattggctcatacgtgcttcaagaaaagagcgtggctgaaaatggagacacggacacccagacttccatgtttttggactcgagaaaggaagattcctacattgaccataaagtcccctgtactgactcccaagttcaggtcaaattggaggatcataagatcgttacggcgtgtttgcccgtggagcatgtgaatcagctgactacagagcctgcaaccggccctttttcggagacccaatcgtcactcagagactctgaagaagaggtagacgttgtgggagattcatcagctagcaaggaacagtgtaaagagaacaccaataatgagttggacacttccctagagagcatgcctgctagcggggaacctgaaccgtctcctgtccttgactgcgtatcagcccagatgatgtcactgtctgaaccccaagaacatcgatacacccttaggacatctcctagaagggctgccccaacaagaggatctcccaccaagaattcatccccttatcgcgagaacggccagtttgaagagaataatctcagcccgaacgagacaaacgctactgtgagcgacaacgtctctcaatccccaacaaacccaggcgagatcagtcaaaacgagaaaggaatttgctgcgatagccagaacaatggaagtgaaggggtcagcaagccacctagtgaggccaggctgaatatcggccacctcccgtcagcaaaggagtccgccagccagcatattaccgaagaagaggatgatgaccccgacgtttattatttcgaaagcgaccacgtagcactcaaacacaataaagactatcaacgtttgctacagactattgctgtcctcgaggcacaaagatcacaggccgtccaggacctagagagtctgggtcgacaccaacgggaagccttaaagaatccaattggctttgtggagaaacttcaaaaaaaggccgatattgggctgccctacccacaacgagtggtccagctgcctgaaatagtttgggaccagtatactcactccctggggaacttcgagcgggaattcaaaaatcgcaagagacacactcggcgagttaagctcgtttttgacaaggttgggttgcccgctaggcctaaatcccctctggaccccaaaaaggatggcgagagtctgtcttactctatgctgcccctgtcagacggacctgagggaagcagcagcaggccccagatgattcgcggtaggctgtgtgatgacaccaaacccgagaccttcaatcaactctggacggtggaagaacagaagaaattagagcagctgttaatcaaataccctccagaggaagtggaaagtcggcgatggcaaaaaattgccgacgaattgggcaatcggacggctaagcaggtggcttcccgcgtacagaagtacttcatcaaacttacaaaggcaggcattcccgtaccagggaggactcctaatctgtacatctacagcaaaaagtccagcacctcacggcgacagcacccactgaacaagcatttgttcaagccatccacgttcatgaccagccacgagcctccagtttacatggacgaagatgatgacagaagctgcttccactctcacatgaatactgcagtggaggacgcgagtgatgacgaaagcatcccaattatgtaccggaatttgccggaatacaaagagttgcttcaatttaagaagctgaagaagcagaaactacagcaaatgcaggccgagagcggattcgtccaacacgtcggcttcaaatgcgataactgtggaatcgagccaatccagggcgtccggtggcactgtcaggactgccctcccgaaatgtctctcgatttctgtgactcttgcagtgactgtctacacgagactgacatccacaaagaggatcatcaattggaacctatttatcggtcagaaaccttcctcgaccgggattactgtgtgtctcagggcacaagttacaactaccttgaccctaattatttccctgctaaccggtag

SEQ ID NO: 26034 - DNA, 111 bp, Artificial Sequence
  Description of Artificial Sequence: Synthetic coding sequence
atggccgcttccagaagcacacgcgtcacaaggtcaaccgtggggctgaatggactggatgaaagcttctgtgggaggaccctgcggaacaggtctattgcgcatccttag

SEQ ID NO: 26035 - DNA, 177 bp, Artificial Sequence
  Description of Artificial Sequence: Synthetic coding sequence
atggctgctagcagatctacaagagttacacgttccactgtcgggctgaatggcctggacgagtcattctgtggacggaccctaagaaatcggtccattgcccatccagaggagatctccagcaatagtcaggtacggagccgatctcctaaaaaacgcccagagcctgtgccctag

SEQ ID NO: 26036 - DNA, 381 bp, Artificial Sequence
  Description of Artificial Sequence: Synthetic coding sequence
atgtccgtgatggatttggccaatacttgcagctcctttcagtctgatttggatttttgtagcgattgtggaagtgtgctgcctttgcctggcgcacaggatactgtcacctgcataaggtgcggatttaatatcaatgtgagagatttcgaagggaaagtggtaaaaacgtcagtcgttttccaccaactcggtactgctatgccgatgagcgtcgaagaggggcctgaatgccaaggtccagtggttgatcgaagatgtcccaggtgcggccacgaggggatggcataccacacccggcagatgagaagcgccgatgaagggcagaccgtgttttatacttgtacgaattgcaagtttcaggaaaaggaggactcatag

SEQ ID NO: 26037 - DNA, 381 bp, Artificial Sequence
  Description of Artificial Sequence: Synthetic coding sequence
atgagtgttatggatttggctaacacctgcagttcatttcagagcgatctagatttttgttcggattgcggttcagtgctgcctttaccaggggctcaggataccgtcacatgtattagatgtggttttaatattaatgttagggatttcgaagggaaggtggttaagacttctgtggtgtttcaccagcttggaactgctatgcccatgtccgtcgaagaaggacctgagtgtcagggtcctgtggtcgacagaaggtgtccccgttgcggccacgaaggaatggcatatcacaccagacaaatgcggtctgctgacgaagggcagactgtgttttatacctgcaccaactgcaaatttcaagaaaaagaggacagctag

SEQ ID NO: 26038 - DNA, 381 bp, Artificial Sequence
  Description of Artificial Sequence: Synthetic coding sequence
atgtcagtcatggatttggcaaatacttgctccagctttcaaagtgatctggatttctgttcagactgcgggagcgtgctgcctctgccgggagcacaggatacagtcacttgcattcgctgcggctttaatattaatgtgcgggattttgaaggtaaggtagtaaagacatctgtggtgttccaccagttgggcacagccatgccaatgagcgttgaggagggtcccgagtgtcagggaccagtcgtcgacaggagatgtcccaggtgcggtcatgagggcatggcatatcacaccaggcagatgcgaagcgccgacgaagggcaaaccgtgttctacacatgcacaaactgcaagttccaagaaaaggaggatagttag

SEQ ID NO: 26039 - DNA, 381 bp, Artificial Sequence
  Description of Artificial Sequence: Synthetic coding sequence
atgtccgtgatggaccttgctaatacctgttccagcttccagtcagatctcgatttctgtagcgattgcggcagcgtgctgcccctcccaggggcacaggataccgtgacatgtatcaggtgcgggttcaatatcaatgtgcgcgactttgagggcaaggtcgtcaaaacgagcgttgtctttcatcagctagggacagcaatgcccatgtcagttgaggaagggcctgaatgccagggccctgtggtggatcgccgatgcccccgatgcgggcacgaggggatggcctatcatacgaggcagatgagatcggccgacgagggtcagacagtgttctatacgtgtacaaactgcaagtttcaggagaaagaagatagttag

SEQ ID NO: 26040 - DNA, 381 bp, Artificial Sequence
  Description of Artificial Sequence: Synthetic coding sequence
atgtcagtcatggatcttgccaatacgtgtagtagctttcagagcgatttagacttttgcagcgattgcggctcagtgctacctctgcctggggcacaagacaccgtgacttgcatccggtgtgggtttaacatcaatgtcagggacttcgagggtaaggttgtgaagacttccgtggtattccatcagcttggcaccgccatgcccatgtccgtagaggaaggcccagagtgtcaaggtccagtggttgatcgtagatgtccacggtgcggccacgagggaatggcctatcatacaaggcagatgagatcggccgatgaaggtcagaccgtattctacacctgcactaactgcaaattccaggagaaagaggacagttag

SEQ ID NO: 26041 - DNA, 381 bp, Artificial Sequence
  Description of Artificial Sequence: Synthetic coding sequence
atgagcgtaatggacctcgccaatacatgctccagcttccagtctgaccttgacttctgctcggattgtggctctgtattgcctctccccggtgcacaggacacagtcacatgcatccggtgtggctttaacattaacgtgagggatttcgaagggaaagtggttaaaacctccgtggtgtttcatcagctagggaccgccatgccaatgtctgtggaagaagggcctgagtgccaaggccctgtggtcgacagaagatgccctcggtgcggtcatgaaggaatggcttaccacacgagacagatgagatcggccgacgaaggccagaccgtgttctacacgtgcacaaactgcaaatttcaggagaaggaggacagctag

SEQ ID NO: 26042 - DNA, 381 bp, Artificial Sequence
  Description of Artificial Sequence: Synthetic coding sequence
atgagcgtaatggaccttgccaacacttgctcaagtttccagagtgacctggatttctgcagtgactgtggatccgtgctgccattgcctggggcacaggacactgtaacctgtataaggtgtggcttcaatattaacgtgcgggatttcgaaggcaaggttgtaaagacttcagtggtctttcatcaactgggtacggctatgccgatgtcagtggaagaaggccctgaatgccaaggccctgtcgtggatcgccgatgtcctcggtgtggacacgaaggcatggcctatcatactcgtcagatgcgctccgccgatgaggggcagactgtgttttacacctgcaccaattgcaaattccaggagaaagaagacagttag

SEQ ID NO: 26043 - DNA, 381 bp, Artificial Sequence
  Description of Artificial Sequence: Synthetic coding sequence
atgagcgtcatggatttggctaacacttgctctagcttccagtcggatctcgatttctgctccgactgtggatctgttcttccactccccggagctcaggatacagtcacctgcattaggtgcgggttcaatataaacgtcagagacttcgaggggaaggtagtgaaaacctccgtagtgtttcaccagcttggtaccgccatgccaatgtccgtggaagagggacccgaatgccagggcccagtcgtggaccggcgttgcccaaggtgcggacacgaggggatggcctaccacacacgccagatgcggtctgctgatgagggacaaaccgtcttttacacgtgcaccaactgcaagtttcaggaaaaggaggatagctag

SEQ ID NO: 26044 - DNA, 381 bp, Artificial Sequence
  Description of Artificial Sequence: Synthetic coding sequence
atgtcagtgatggatctggcaaacacatgttccagcttccagtctgaccttgatttttgtagcgactgcggatccgtgctcccactaccaggcgcacaagatactgtaacttgcatccggtgtgggttcaacatcaatgtaagggattttgagggcaaggtcgtaaagacaagtgttgtcttccaccagctgggtactgcgatgcctatgtccgtggaggagggtcccgagtgtcagggcccagtcgtcgaccgacggtgccccagatgcgggcacgaaggaatggcctatcacactcgccaaatgagaagtgctgatgagggccaaaccgtattctacacttgcaccaattgcaaattccaagagaaagaagattcatag

SEQ ID NO: 26045 - DNA, 381 bp, Artificial Sequence
  Description of Artificial Sequence: Synthetic coding sequence
atgtctgtgatggatttggctaatacttgcagctcgtttcaatcagatctggacttttgttcggactgcggctcagttctacccctccctggcgcacaagacacagtaacctgcatccgatgcggcttcaatattaatgttagggattttgagggtaaagtggtaaagacctcagttgtctttcaccagttgggtaccgcaatgccaatgtctgttgaagagggacctgagtgtcagggccctgtggtcgatagaagatgtccgcgatgcgggcatgagggaatggcttatcatactcggcagatgaggagcgccgatgaaggtcaaactgtgttttacacttgcaccaactgcaagttccaggagaaagaagactcctag

SEQ ID NO: 26046 - DNA, 381 bp, Artificial Sequence
  Description of Artificial Sequence: Synthetic coding sequence
atgtccgtcatggatcttgctaacacatgtagctctttccagtccgatctagatttctgcagcgattgtggatctgtactgccattgcccggagcacaggataccgtgacctgtatacgttgtggctttaacattaatgtgagggatttcgaaggaaaggtggtgaagacttccgtcgtgtttcatcagcttggaaccgccatgccgatgtctgttgaagagggaccggagtgtcagggccctgtggttgaccgtcggtgcccgcgatgtggccatgagggtatggcatatcatacacgacagatgagatccgccgacgaaggccagacggtgttctacacttgcactaactgtaagttccaagaaaaggaagactcctag

SEQ ID NO: 26047 - DNA, 381 bp, Artificial Sequence
  Description of Artificial Sequence: Synthetic coding sequence
atgtccgtgatggacctggcgaatacgtgtagctctttccaatcggatctagacttctgcagcgactgtggaagcgtgcttccccttccaggcgctcaggacactgtgacatgcatccgatgtggctttaatattaacgttcgcgattttgaggggaaggtagtgaaaacttcagtagtcttccatcagttgggaacagccatgccaatgtcggtcgaggagggacctgaatgtcaaggccctgtggtggacagacgctgtcctcgctgcggacatgaaggcatggcataccacacacgccagatgcgatccgccgacgaaggacagaccgttttctacacatgtaccaactgcaagtttcaagagaaagaggactcttag

SEQ ID NO: 26048 - DNA, 381 bp, Artificial Sequence
  Description of Artificial Sequence: Synthetic coding sequence
atgagcgtaatggacttggctaatacttgctcgagtttccaaagcgatctggatttctgcagcgattgtggctccgtactccccctaccaggggctcaagacaccgtcacctgcatcaggtgcggatttaatataaacgtgcgcgatttcgaaggaaaggtggtgaaaacttcagtcgtgttccatcagttgggcacggcaatgcctatgtcggtagaagaagggccagagtgtcagggacccgtagtcgatagacggtgtcctcgctgcggccacgagggaatggcgtaccacactagacagatgaggagcgctgacgagggacagaccgtgttttatacctgtaccaattgtaagttccaggaaaaggaagactcttag

SEQ ID NO: 26049 - DNA, 381 bp, Artificial Sequence
  Description of Artificial Sequence: Synthetic coding sequence
atgtccgtgatggacctggctaacacttgctccagtttccaaagcgacctcgatttctgctcagactgcggaagcgtactgccactgccaggcgctcaggacacagtgacctgcattcggtgcgggttcaacattaatgtccgagactttgaaggcaaagtggttaagacaagcgtagtctttcatcagctcggaacagcaatgcccatgtctgtggaagaagggcctgaatgccagggacccgtggtggatcgtcgatgccccaggtgtggccacgagggaatggcataccacacgagacaaatgaggtctgctgatgagggccaaaccgtgttttatacctgcaccaactgcaagttccaggagaaggaggattcttag

SEQ ID NO: 26050 - DNA, 381 bp, Artificial Sequence
  Description of Artificial Sequence: Synthetic coding sequence
atgtccgtgatggaccttgccaatacatgctcctcctttcaatccgacttggacttctgttctgattgtggaagcgtgctgcccctgccaggagctcaggacacggttacgtgtatcaggtgtgggttcaatatcaatgtgcgtgactttgagggcaaagtcgttaagacgtcagtggtctttcaccaacttgggaccgccatgcctatgagcgtcgaagaagggcctgaatgtcagggcccagttgtggacagacggtgcccgagatgcggccacgaaggaatggcttatcatacgcgtcagatgagaagcgcggatgagggccaaacagtattctatacatgcacaaactgtaaattccaggagaaggaagactcctag

SEQ ID NO: 26051 - DNA, 381 bp, Artificial Sequence
  Description of Artificial Sequence: Synthetic coding sequence
atgagcgtgatggacctggccaatacttgtagcagcttccaatccgacctggacttttgcagcgattgcggctcagtcctcccactgcccggtgcgcaggatacagtcacttgcataaggtgcggattcaacatcaacgtgcgggatttcgaggggaaggtcgtgaaaacttcggtggtttttcaccagctcggcaccgctatgcccatgtccgtcgaagaggggcctgaatgtcagggcccagttgtcgatcgacgctgcccccgatgtggccatgagggtatggcataccatacaaggcagatgagatccgccgacgaggggcagacagtgttttacacatgcactaactgcaaattccaggaaaaagaggattcttag

SEQ ID NO: 26052 - DNA, 381 bp, Artificial Sequence
  Description of Artificial Sequence: Synthetic coding sequence
atgagtgtgatggacctagcgaatacctgctctagctttcaaagcgatctggatttttgttctgactgcgggtccgtgctgcccctgccgggtgcccaagataccgtcacctgcattagatgtggctttaatatcaatgtgcgtgatttcgaaggcaaggtggtaaagacatcagtagtcttccaccagctggggaccgcgatgcctatgagtgtcgaagaaggtccagaatgccagggcccagtggttgatcggagatgtccgagatgcgggcatgaaggcatggcgtaccatactcggcagatgagatccgcagacgagggccaaactgtgttctatacatgcactaactgtaaatttcaggagaaagaggattcctag

SEQ ID NO: 26053 - DNA, 381 bp, Artificial Sequence
  Description of Artificial Sequence: Synthetic coding sequence
atgagcgtgatggatttggctaatacttgttccagcttccaaagcgacttggacttctgctccgattgcggctcggtgcttcccctgcctggagcacaagatacagttacttgtataaggtgtggctttaatatcaacgtacgcgacttcgaaggcaaggtcgtaaagacatcggtggtgttccaccagcttgggaccgcaatgccaatgagcgtagaggaaggacctgagtgccagggcccagttgtcgaccgcaggtgtcccaggtgtggtcacgaagggatggcctaccacacccgccagatgcggtctgctgatgaaggacagacagtgttttatacctgtaccaactgtaagtttcaggagaaagaagatagctag

SEQ ID NO: 26054 - DNA, 381 bp, Artificial Sequence
  Description of Artificial Sequence: Synthetic coding sequence
atgagtgtgatggacttagcgaacacctgctcgtcgttccagtcggatctggacttctgctcggattgtggctctgtgttaccactgcccggagcccaagataccgtgacgtgtatcaggtgtggctttaacattaacgttagggacttcgaagggaaggttgtgaagacatctgtagtgttccatcaattgggcacagcaatgcccatgagcgtcgaagaaggacccgagtgccaaggaccggtagtggatcgtagatgtcccaggtgtggacatgaaggaatggcctaccacaccagacaaatgagaagcgccgatgaggggcagacagtgttttatacctgcacaaattgtaagtttcaggaaaaagaagacagttag

SEQ ID NO: 26055 - DNA, 381 bp, Artificial Sequence
  Description of Artificial Sequence: Synthetic coding sequence
atgagcgtcatggatcttgcgaatacatgcagtagctttcagagcgacctcgacttttgcagcgactgcggaagtgtgctgccgctccccggagctcaagatacagtcacctgcatcaggtgcgggtttaatataaatgtgcgcgacttcgaaggaaaagttgttaaaactagcgtggtgtttcatcagctgggtactgcaatgcccatgtccgtggaggaaggaccagagtgtcaaggccctgtggtcgacaggcgctgcccaaggtgcggacacgaggggatggcctatcatacaaggcaaatgaggtctgcagacgagggacagactgtgttctacacctgtacgaattgtaaattccaagaaaaggaggattcatag

SEQ ID NO: 26056 - DNA, 381 bp, Artificial Sequence
  Description of Artificial Sequence: Synthetic coding sequence
atgagcgtaatggatttggctaacacttgtagttcctttcagagtgatttggacttctgctctgattgcggctcagtgctaccactccctggggcacaggataccgttacctgcatccgttgtgggttcaatatcaacgtgagggacttcgagggcaaggttgtgaagacctccgttgttttccaccaactcgggaccgccatgcccatgagtgtggaggagggacccgaatgccaggggccagttgtggacaggcggtgcccgagatgcggacacgaaggcatggcatatcacactcggcagatgcgctcagccgatgaaggccagactgtgttttatacatgtactaattgcaagttccaagaaaaggaggacagctag

SEQ ID NO: 26057 - DNA, 381 bp, Artificial Sequence
  Description of Artificial Sequence: Synthetic coding sequence
atgtccgtgatggatttggcgaatacttgttctagcttccagagtgacttagatttttgttcagattgcgggtcagtgcttccgctaccgggtgctcaagacactgtgacatgcattaggtgtggtttcaatataaatgtacgggactttgagggtaaagtggtgaaaacatcggtggtgtttcaccagctgggaacagctatgccgatgtccgttgaggagggtcctgaatgtcaaggccctgtggtcgatcggaggtgcccccgatgtggccacgagggcatggcttaccatacgcgccaaatgaggtccgccgatgaaggacagacggttttctacacatgtacaaactgtaaattccaggaaaaggaagactcttag

SEQ ID NO: 26058 - DNA, 381 bp, Artificial Sequence
  Description of Artificial Sequence: Synthetic coding sequence
atgtctgttatggacctcgctaatacttgctctagtttccagtcagatctagatttttgctccgactgtggctccgtgcttcccctgccaggagctcaggacactgtcacttgcatcagatgcggattcaacattaatgtgagagactttgagggcaaggtagtcaagacctcagtggttttccatcagctcggaacagcgatgccaatgtctgtcgaagagggtccggagtgtcaggggcctgttgtggacagacgatgtcccaggtgcggacatgagggcatggcttaccacacaaggcagatgaggagtgcagacgagggtcaaacagtgttctacacctgcactaattgtaagttccaggagaaggaggatagttag

SEQ ID NO: 26059 - DNA, 381 bp, Artificial Sequence
  Description of Artificial Sequence: Synthetic coding sequence
atgtctgtgatggacctagctaatacatgttcctcctttcaatctgacctggatttttgcagcgactgcgggtctgtattgcctctaccaggagcccaggatactgtcacctgtatccggtgcggatttaatataaatgtgcgcgacttcgagggcaaggtggtgaagacctctgtggttttccaccagttggggaccgccatgcccatgtccgtagaggaggggcctgaatgtcaaggccctgttgtggacagaaggtgccctcgatgtggacacgaagggatggcttaccacacccgccagatgcggagcgcagacgaaggccagactgtcttttacacttgcacaaattgcaaatttcaggaaaaggaggatagttag

SEQ ID NO: 26060 - DNA, 381 bp, Artificial Sequence
  Description of Artificial Sequence: Synthetic coding sequence
atgtcagtgatggatctcgctaacacatgcagctctttccagtccgatctcgatttctgctccgattgtggttctgtgctgcccctgcccggagcccaggacactgtgacatgtattcgatgcggctttaacataaatgttcgcgattttgaggggaaggtcgtcaagactagcgtggttttccaccagttgggtacagcaatgcctatgtctgtggaagagggtcctgagtgtcaaggtcctgtggtcgatcgcagatgtccacgctgcggtcatgagggtatggcataccatactcgccagatgcggagcgccgatgaaggccaaaccgtattttacacatgcacgaactgcaagtttcaggagaaagaggattcttag

SEQ ID NO: 26061 - DNA, 381 bp, Artificial Sequence
  Description of Artificial Sequence: Synthetic coding sequence
atgtcagtcatggatctggccaacacctgcagttctttccagagcgacctggacttttgcagcgattgcggctccgttctacctctccccggtgcacaggataccgtgacttgcattcgttgcggctttaacattaacgtgcgagatttcgaaggaaaggtagtcaagacttccgtggtcttccaccaactgggaaccgccatgcctatgtcagtggaagaggggcctgagtgtcaggggccagttgtggataggcgctgcccacggtgtggacacgaaggaatggcctaccatacacggcagatgaggtcggctgacgaggggcagacagttttctacacgtgtacgaactgcaaattccaggaaaaggaggactcatag

SEQ ID NO: 26062 - DNA, 381 bp, Artificial Sequence
  Description of Artificial Sequence: Synthetic coding sequence
atgtctgtgatggatctagctaatacatgcagctcgtttcagtctgacctggatttctgcagtgattgtggctctgtgctgcccttgccaggcgctcaggacacagtaacctgtattcggtgtggattcaacataaacgttcgagactttgagggcaaagtagtgaaaacatcagtcgtcttccaccagcttgggactgcgatgccaatgtccgtcgaggagggacctgagtgccaggggcctgtggtcgaccgtcggtgtccgcgttgtggacacgaggggatggcctatcacactagacagatgagaagtgccgatgaggggcagacggtgttctacacttgcactaattgcaaatttcaggagaaggaggattcatag

SEQ ID NO: 26063 - DNA, 381 bp, Artificial Sequence
  Description of Artificial Sequence: Synthetic coding sequence
atgtcagtgatggatctggcaaacacgtgttcctcttttcagtctgacctggatttctgttccgattgtgggtctgtgcttcctttgccgggagctcaggacaccgtcacctgcatccgctgtggatttaacatcaatgtgagggacttcgaggggaaggtggtcaagacttctgtagtatttcaccagttggggaccgcaatgccaatgtccgtagaagagggacccgaatgtcagggtcccgtggtcgatcgacgttgcccgagatgtggccacgaaggaatggcttatcatacccggcagatgagaagtgccgacgagggccagaccgtcttttatacttgcactaactgcaaattccaggaaaaagaggactcctag

SEQ ID NO: 26064 - DNA, 381 bp, Artificial Sequence
  Description of Artificial Sequence: Synthetic coding sequence
atgagtgtgatggatctggcaaacacctgctcatcttttcaatcagacctcgacttctgttcagactgcggttctgtgctacccttacctggggcacaggataccgtaacctgcatcagatgcggttttaatataaatgttagagattttgaagggaaagtggtgaagacaagtgtagtcttccaccagctgggcaccgctatgccaatgtccgtggaggagggtcctgagtgccaggggcctgtagtcgataggagatgcccaaggtgcggccatgaaggtatggcctaccataccagacagatgaggtctgctgacgaggggcagactgttttttacacttgcacaaattgcaagtttcaagagaaggaggattcgtag

SEQ ID NO: 26065 - DNA, 381 bp, Artificial Sequence
  Description of Artificial Sequence: Synthetic coding sequence
atgtccgtaatggacctcgcgaacacctgtagctcttttcagtccgatcttgacttctgctccgactgcggttcggtgctcccactaccaggggctcaggacacagtgacatgtattaggtgcggtttcaatatcaacgtacgggatttcgaagggaaggtcgtgaaaacttcagtggtcttccaccaactcggtactgccatgccaatgagcgtggaagaaggtccggagtgccaggggccagtcgtggatcgccgatgtccacgttgtgggcacgagggtatggcctaccacacacgacagatgcggagtgccgatgaaggacagaccgtgttttatacatgcactaactgcaagttccaagagaaggaggatagctag

SEQ ID NO: 26066 - DNA, 381 bp, Artificial Sequence
  Description of Artificial Sequence: Synthetic coding sequence
atgagcgtgatggacctggccaatacatgttccagcttccagtccgacctcgatttttgtagcgactgtggatcagtactccccttgcccggagcccaagataccgtgacgtgcatcaggtgtgggtttaatatcaacgttcgggactttgagggcaaggtggtgaagactagcgttgtgttccaccagctgggcactgcgatgccgatgtccgtcgaggaggggcctgagtgccagggccctgtcgtagacagacgatgcccccgttgcggtcacgaggggatggcctaccacacaagacagatgcgttctgcagatgaaggtcagaccgtgttctatacatgtaccaattgcaagttccaggagaaggaggatagctag

SEQ ID NO: 26067 - DNA, 381 bp, Artificial Sequence
  Description of Artificial Sequence: Synthetic coding sequence
atgtccgtgatggatcttgctaacacttgctcctcttttcagtccgatctagatttttgtagcgattgcgggtccgtgctccctctccccggagcccaggacaccgtaacatgcatacgttgtggattcaacatcaacgtccgcgactttgagggaaaagttgttaagacctccgtcgttttccatcaactggggacagccatgcccatgtccgtagaggagggccctgagtgccaaggtccagttgtggatcggaggtgccccagatgcgggcatgagggcatggcttaccacacacgccagatgcggagcgcagacgagggccaaacggtgttctatacctgcacaaactgtaagttccaggaaaaggaggatagctag

SEQ ID NO: 26068 - DNA, 2133 bp, Artificial Sequence
  Description of Artificial Sequence: Synthetic coding sequence
atggaccttcccgcactgctgccagcacccaccgcgaggggaggacagcatgggggaggacctggacctctcagacgcgcaccagcacccttgggtgcgtctccagctcgcagacgtctgttgcttgtgcggggtccagaggacggaggcccaggggcacgaccaggcgaggcatcagggccatctcccccaccagccgaagatgacagtgatggggattccttccttgtgctgttggaggtgccgcatggaggggcagccgctgaggcggctggttctcaggaggccgaacccggatcccgtgtgaatctcgcatcaagaccagaacaggggccatcaggaccagccgcacctcctgggcctggggtggcacctgctggcgctgtgacaatcagcagccaggatctgctggttaggcttgatcgaggagtcctggcactgagcgcacctcctgggcctgccaccgcaggcgcagctgcgcctcgtcgcgctccacaggcgagcggcccttctactcctggttatcgttgccctgagccacagtgtgctctagcttttgcgaagaagcatcaactcaaagtgcacctgctgacacacggtgggggtcaaggacggaggcccttcaaatgccccctggaaggttgcggctgggcgtttacaaccagctacaaattgaaaaggcacttgcagagtcatgataagctgcgtccatttggatgtcccgttgggggatgtggcaaaaagtttacaacggtgtacaacctgaaagcccacatgaagggccacgagcaagagagcctgttcaagtgtgaggtctgcgctgagcggttcccgacgcatgctaaactatcgtcccaccaacggagtcacttcgaaccggagaggccatataaatgcgactttcctggctgtgaaaagaccttcatcaccgtgagtgcgctcttctcacacaaccgtgcccatttcagagaacaggagttgttcagctgcagctttccaggttgctccaagcagtatgataaggcctgccgtttgaagatccacctccgcagccacaccggggagagacccttcatatgcgactctgattcctgtgggtggaccttcacatccatgagtaagctactcaggcaccgtcgaaaacacgacgacgatagacggttcacctgccctgtggagggatgcgggaagtcgttcacacgcgctgagcatctcaaagggcactccatcactcaccttggcactaaaccctttgaatgccccgtcgaaggctgctgtgcacgttttagcgcacgcagtagcctgtatatacactccaagaaacatgtccaagatgtcggggctccaaaaagcagatgtccggtcagtacctgcaaccgtctgttcacatccaagcactctatgaaggcccacatggtgcggcaacatagtcggaggcaggatttgctccctcagcttgaggcccctagctcactcaccccctcttctgagctgtcatcaccgggacagtccgaactgactaatatggatctggctgcactcttctcggatacccctgcaaacgcctccggcagcgccggagggtctgacgaggcgctgaattccggaatcctcaccatcgacgtcaccagcgttagctcctcacttggtgggaacctgccagccaacaactctagtcttggccctatggagcccttagttcttgtcgcccattccgatattccaccttccttagactctccactggtactcgggacggcagcaaccgttctgcaacaaggcagcttcagtgtggacgacgtccagactgttagtgccggagcgttgggctgtctggttgccctccccatgaaaaatctcagcgatgaccccctcgcactcaccagcaactcaaatcttgctgctcacattacaacgcccacttcatcgtccacgcctcgggagaatgcctccgtgccggagctactcgcccctattaaggttgagccggattcgccttctagacccggagccgtgggtcagcaggaagggtcccatggattaccacagtcaactttaccctcacccgcagaacagcacggagctcaagacactgagctttcggctgggactggcaatttttatctggtttag

SEQ ID NO: 26069 - DNA, 2577 bp, Artificial Sequence
  Description of Artificial Sequence: Synthetic coding sequence
atggaccttcctgctttgctgccagcccctactgcccgaggaggccagcacgggggaggtcctgggccactgcgccgagcacctgcgcctttaggagcctccccagcacgtcgccgactgctcctagtgaggggacctgaagatggcggtcctggagcacggccaggtgaggcctcagggccttcacctccccctgcggaagacgattcagacggagatagctttctggtgttgctggaagtaccccacgggggagccgctgccgaggcagccggaagccaggaggcagaaccaggctctagggtgaatttagcttcaagacctgagcaaggtccatctggtcccgcagctcctccaggtcctggtgtggccccagccggtgcagtaacaatctcctcccaggatctactggtcaggttggatcgcggagtcttagcgttgagcgcccctcctgggcctgctactgccggagcagctgccccacgcagggcacctcaggccagcggcccatccacaccgggttataggtgtcccgaaccccagtgcgcactcgcattcgctaagaaacaccagctgaaggtccacctgctgacccacggcggaggacaggggaggcgcccatttaaatgcccgctggaagggtgcggctgggccttcaccaccagttacaagctgaagcgccacttgcagtcacatgacaagcttaggccctttgggtgtcccgtaggaggttgcgggaagaagtttaccaccgtttacaacctgaaagctcatatgaaaggacatgagcaggaatccctgttcaagtgtgaggtgtgtgcggaaagattccctactcacgccaaactgagttctcatcagagaagccactttgaacctgaacgcccatataaatgcgacttcccgggttgtgagaagacatttataacagtgagcgctctgttttcccacaaccgagcacacttcagagaacaagaattattttcgtgtagttttcccggttgttctaagcagtacgacaaggcatgcagattaaaaatccacctccggtcgcacacaggcgaacggcctttcatttgtgatagtgacagctgtgggtggaccttcacgagcatgagcaagttgctgcgacaccgaaggaagcatgatgacgataggcgattcacatgccccgtcgaaggatgcggcaagagctttacccgagccgagcacctgaaaggccactccattacccatctaggaactaagccttttgaatgtcccgtggaaggatgttgtgccaggttctcggcacgctcctccttgtacattcattccaaaaaacacgtgcaggacgtcggtgctcccaagtctcgctgtcctgtaagcacctgtaatcgtctcttcacgtctaagcattccatgaaggcccacatggtacggcaacactcgcgtcgacaggacttattgccccaactggaggccccaagctcgttgacgccttcctcggagctctcctcccctggacagagtgagctaacaaacatggacttagcggctctgttttctgatacccccgcaaatgcatcgggcagtgctggcggatcagatgaggccttaaatagcggaattcttactatcgacgttacatctgtgagctcatcactggggggaaacctccctgccaataactctagcctaggccctatggaaccactggttctggtggcccatagcgacatacccccatcgctggacagccccctcgtccttggaaccgccgcaacagtcctgcaacaggggtccttctccgtggacgatgtccagaccgtaagtgccggagccctggggtgcctagtcgctctgccaatgaagaacttatcagatgaccccctcgctcttacgagtaactcaaatcttgccgcacacatcaccacgcctactagtagctcgacacccagagagaacgcctctgtccccgagcttttggcacctatcaaagtagaacctgatagccctagccgaccgggagccgttggacagcaagaaggttcacacggactccctcagagcacactgccttcacccgcagaacagcatggggcacaggacacagagctatccgctgggaccgggaacttttacctggagagcggagggagtgccagaacggattaccgcgcaatacagctcgctaaagaaaaaaaacagaggggggctggaagcaacgccggtgctagccagtccactcaaagaaaaatcaaggagggcaaaatgtctccaccccactttcatgccagccaaaattcatggttgtgtgggtctctggtggtcccatccgggggacgcccaggcccagcgccagctgctggcgtgcagtgcggagcccagggggtgcaggtgcagctagtgcaggatgacccttcaggagagggggtacttccaagcgccaggggaccagcaacatttctcccatttttgactgtggaccttccggtgtacgtgctccaggaggtgcttcctagcagcggcggtcctgctggaccagaagccacacaattccctgggtcgacgataaaccttcaggacctgcagtag

SEQ ID NO: 26070 - RNA, 4458 nt, Artificial Sequence
  Description of Artificial Sequence: Synthetic coding sequence
auggccgccccagcacaaccgaagaaaaucguugcuccuacagugucacagaucaacgcagaauucgugacacaguuggcauguaaguauugggccccacacauuaaaaagaaaucgccauucgauauaaagguuaucgaggauauuuacgagaaagagaucgugaagaguagauuugccauucggaaaaucaugcuuuuggaauuuucccaguacuuggagaacuacuuguggaugaacuacuccccggaaguuagcucgaaggcuuaucuuaugucuaucugcuguaugguuaaugagaaauuccgcgaaaauguccccgcuugggaaauauuuaaaaaaaagcccgaccacuucccuuuuuucuucaaacauauucugaaagccgcacucgccgagacagauggugaauuuucacuccacgaacagaccguacuucuccuuuuucuagaccacuguuucaauucucuggaaguugaucugauaagaagccaaguccagcagcuuauuucccuacccauguggaugggccuucagcuggcuagacuggaauuagagcucaagaaaaccccuaaacugcggaaguucuggaaccugaucaaaaaaaaugacgaaaagauggaucccgaggcccgggaacaggcuuaccaggagcguagguuucucucacaacucauccaaaaguuuaucagcguguugaagagcguaccgcugucagaacccgugacuauggacaaaguccacuacugcgagcgguucauugagcugaugaucgaucuggaagcccuauugccuacuaggagaugguuuaacacuauacuggacgauucgcaccugcuuguacauuguuacuuaucuaaccugguuagacgagaagaagacgggcaucuauuuagucaacuccuggauaugcugaaguuuuauacuggcuuugaaauuaacgaccagacaggcaacgcccucaccgaaaacgagaugacuaccauccacuaugauagaaucacaucucugcaacgugcugcauucgcccauuucccggagcuguacgauuucgcuuugucaaacguagccgaaguggauacuagggagagccugguuaaauuuuucggcccgcuauccuccaauacauuacaccagguugcuucuuacuuaugcuugcugccuacucucccuaaaaaugaggacaccacuuucgacaaagaguuucuucuugagcugcuggucucacggcacgaacgucgcauuagccagauucagcagcugaaccagaugccacuauauccuacagagaaaauuaucugggaugagaauauugugccaacugaguacuacucgggagaagguugcuuggcacugccaaaacucaaucugcaauuucugacccuacacgauuaucucuugagaaacuucaaccuguuucgucuggaguccaccuacgagauucgccaggauaucgaggacagcguuucacgcaugaagccauggcaguccgaauacggcgguguggucuucggcgggugggccagaauggcccagcccauaguggcuuucacgguuguagaaguggccaagccaaacaucggagaaaacuggcccacgcgagugagagccgacgugaccauaaaccugaacguccgcgaccauaucaaagacgaaugggaaggccuaaggaagcacgaugugugcuuucugaucacaguuagaccaacuaagcccuaugguacuaaauucgacagacgaaggccauuuauugagcaaguuggacugguguacguccgagguugcgaaauccagggaaugcuugaugauaagggccgggucaucgaagacgguccugagccuagaccaaaucugaggggagagucgcggaccuuccggguuuuccuggaccccaaccaguaccagcaggauaugaccaauaccauucagaauggagccgaggacguguacgaaacuuuuaauaucauaaugcgccggaagccaaaagaaaacaacuucaaggcugugcucgagaccauccggaaccucaugaacaccgauugcguugucccagacuggcuccaugauauuauccuuggcuacggcgacccaagcucagcccacuauucuaagaugccuaaccagaucgccacuuuggauuuuaacgauaccuuccucagcauugaacaccucaaggccagcuuucccggacauaaugugaaggucacaguggaggaccccgcccuucagauuccaccauuucguauaacauuuccaguucgauccggaaaaggcaaaaagagaaaggacgcagacgucgaagacgaggacacagaggaagcuaagacgcuuauuguugagccacacgugaucccuaaccgaggaccuuaucccuauaaucagccaaagaggaauacuauucaguuuacccacacgcagaucgaagccaucagagccggcaugcagcccggccuaaccauggucguuggcccgccagggacuggcaagacugacgucgccguucaaauuauaaguaauaucuaccauaacuuuccugagcaacgaacacugauugucacucacagcaaccaggcgcugaaucaguuauuugagaaaauuauggcccuggauaucgacgagcgccaccuucuaaggcugggacacggagaggaggagcuggaaaccgaaaaagacuucucccgauacggacgggugaauuauguguuggcaagaagaauugaacuccuugaagaagucaagagacugcagaagucccugggcguuccuggcgacgccucauauacgugugaaacagccggguacuucuuccuguaucaggucauguccaggugggaggaguauauaucgaaagucaaaaacaaaggcagcacacuuccggaugugacagaggugagcacuuuuuuuccauuccacgaauauuucgcuaacgcuccucagccgaucuuuaagggaaggucuuacgaggaagacauggagauagccgaaggaugcuuucgucacauuaaaaagauuuuuacccagcuugaggaauuccgcgccagugaacuccuucguagcggucucgacagaagcaaguaccugcugguaaaagaagcaaagaucaucgcaaugacuugcacccaugcagcucugaagcgccaugaucucgugaaacugggauucaaguacgacaacaucuuaauggaagaggcagcgcagauccuggaaauagagacuuuuauacccuugcuccugcagaauccucaggacggauucaguaggcuaaagagauggauaaugauuggugaccaccaucaguugccgccagugaucaagaauauggccuuccagaaguacucaaauauggagcagagccuguucacuagauucgugcggguuggcguuccaaccguggaccucgaugcccagggucgcgcgagagcaucacucugcaaccuguauaauuggagauacaagaaccugggcaacuuaccccauguucagcuucugccagaauucaguacagcuaaugccggccuccucuacgacuuccaacucaucaauguagaagacuuccagggggucggagaguccgaaccuaauccauacuucuaucagaaucuuggugaggcggaguacgucguugcacuguuuauguauaugugucucuugggcuaccccgcugacaagaucuccauccugacgacauacaacggucagaagcacuugauucgggauaucauaaaucggcggugcggcaauaaucccuugaucgggagaccgaauaaggugacaacgguggacagguuccagggacagcaaaaugacuacauccuucugucucuggugcgcacccgagccgugggacaccugcgagacguucgaaggcuggugguugcuaugagccgggcgcggcuuggacucuacauuuuugcacgugugucucuguuccagaacugcuuugaguuaacaccagccuuuucucaguuaacagcuagaccauugcacuuacacauaaucccgaccgaacccuuuccaaccacacgcaaaaauggagagcgaccuagccaugaggugcagauaaucaagaacaugccucaaauggcaaacuuuguguacaacauguacaugcaucuaauccagacuacccaccacuaucaccagacccugcuacaacugccuccggccaugguggaggaaggcgaggagguucagaaucaggaaacugagcuagagacggaggaggaagccaugaccgugcaagcagacaucauucccuccccaacagacacgagcugucgccaggagaccccagcguuccagaccgacacaaccccuuccgaaacuggagcgaccucgacacccgaagcuauccccgcucucagcgagaccaccccuacuguugugggcgcaguguccgcccccgccgaggccaacacaccucaggacgccacaagcgccccugaagaaaccaaguag

SEQ ID NO: 26071 - RNA, 783 nt, Artificial Sequence
  Description of Artificial Sequence: Synthetic coding sequence
augaaaucaaauaucgacaagaaguuuuccgcccauuaugacgccguagaagccgaauuaaaaagcagcacggucgggcuuguuacauuaaacgauaugaaggccaagcaggaagcccuggucaaagaacgggaaaaacaguuggcaaaaaaggagcaaagcaaagagcugcagaugaaacucgaaaagcugcgggaaaaagagcgcaagaaggaggcaaagcgaaaaaucucaucccuuucauuuacacuggaagaggaagaggaaggcggggaagaggaggaagaagcagcaauguaugaggaagagauggagagagaagagauuacgacgaaaaagcggaagcuggguaagaauccugauguugacacaucguuuuugccggaccgugaccgagaagaggaagaaaacagacugagggaagaacugcgccaagaaugggaagcaaaacaggagaagaucaagucagaggagaucgagauaacauucagcuacugggacggcaguggucaucggaggaccgugaaaaugaggaagggcaacacaaugcagcaauuucugcagaaagcccuagagauacugcgcaaggacuucagcgaacugagauccgcugggguggagcagcugauguauauaaaagaggaucugaucaucccccaucaucacuccuuuuaugacuucaucgugacaaaagccaggggaaaaaguggaccgcuguucaauuucgauguucaugacgauguucggcuacugucugacgcuacuguggagaaggaugaauag

SEQ ID NO: 26072 - RNA, 1725 nt, Artificial Sequence
  Description of Artificial Sequence: Synthetic coding sequence
auggcuuccgaccuagagucaucuuuaacauccauugacuggcucccucagcucacacuuagagcuaccaucgaaaaacucggcagugccagccaggccggacccccagggucuucaaggaaauguagcccaggcaguccgaccgacccuaacgccacucuaaguaaggacgaagcugccguacaucaagacgggaaacccagauacuccuacgccacccucauuaccuacgccauuaacagcaguccugccaagaagaugacuuugucagaaauuuauagguggauaugugacaauuuccccuauuacaagaaugccggcauaggauggaagaauagcauucgccacaaccucaguuuaaauaaaugcuucaggaagguccccaggcccagagacgacccaggaaaaggaucuuacuggaccauagauaccuguccagauauuagcaggaagcggcggcacccgccagacgacgaucuuucccaggacagccccgagcaggaagcuucuaagucaccccggggcggaguugcugggagcggcgaagcuagucugccuccugagggcaacccacagaugucacuccaauccccaacgucgaucgcauccuauucacaggggacggguagcguagauggcggagcgguggccgccggggcauccggucgcgagucugccgaaggcccaccuccccucuacaacacaaaucacgacuuuaaauucucuuacagugagauaaauuuucaggacuugucguggucauuccgcaaccuguauaaaagcaugcucgagaagucaucuucgaguucucagcacggauuuagcagccuguuaggagacauuccuccaaguaauaacuauuacauguaccagcaacagcagccuccucccccacaacaacagcaacaacagcaacaaccaccacagccucccccccagcaaucccagccacagcagcagcaggccccugcacagggccccagugcugucggaggagcaccaccucugcacacuccgagcacugaugggugcaccccaccaggcggaaaacaggccggggccgaggguuacgggccgcccccagugauggccaugcacccuccaccguuacagcacgggggcuaucacccacaccagcaucauccccacagccaucccgcgcaacagcccccuccaccgcagccccaggcucagggucaggcaccuaucaacaacacagguuuugcauuccccuccgacuggugcagcaauauagauucucugaaagagaguuucaaaauggucaaccgccugaauuggucuucuaucgagcaaagucaguuuagugaguuaauggagagccuucgccaggccgagcagaagaacuggacucuggaucagcaucacaucgccaaccugugugacagccucaaccacuuccucacacagaccggccaugugccuccucaggguggaacucaccgucccccugccccugccagaauugcagacagcugugcucuaacuuccgggaaacaagagucagcaaugagucaagugaacucauaugggcauccgcaggcgccacaucuguacccuggacccucacccauguacccuaucccuacgcaggauuccgccgguuauaacagaccugcccaccacaugguuccgcggccuucagugccuccuccaggcgccaacgaagagauuccugacgacuuugacugggaccuuauuacauag

SEQ ID NO: 26073 - RNA, 1431 nt, Artificial Sequence
  Description of Artificial Sequence: Synthetic coding sequence
auggcugacagcaaagaggggguccuccccuugaccgcagcgagcacugccccaauuaguuucggauuuacacguacgagugcgaggagaaggcuugcagacaguggcgauggcgcuggaccuagccccgaagaaaaagacuucuugaagaccguugaaggccgagaauuacaaagcgugaaaccacaggaggccccaaaagagcuugucauuccccugauacagaacggucacagaaggcaacccccagcaagacccccgggaccuucgacugacaccggggcccuggccgacgggguagugucacaggcaguuaaggaacugaucgcggaaucuaaaaagagccuggaagaacgugaaaaugcaggugucgacccuacccuugcgauccccaugauacaaaagggguguacgccuagcggcgaaggggcagacucugagccgagggcagagacugugcccgaggaggcgaacuacgaagcugugcccgucgaagccuacggccuugcgaugcucaggggcaugggcuggaagcccggugaggguauaggacgcaccuuuaaucaaguugugaagccaagagugaacucccugagaccaaaggguuuaggacucggagccaaucucacugaggcacaggcccucaccccuaccgggccaucuagaaugccccgucccgacgaagaacaggagaaagacaaagaggaccaaccucagggacucguaccuggcggggcuguuguggugcugagcggcccacacagaggacuuuauggcaagguagaaggccuggaucccgauaauguaagagccaugguacggcuggcugugggcucacggguggugaccgugucugaguauuaucuccgccccguuagccagcaggaguuugacaaaaauacauuagauuuacgacagcagaacggcacagcaaguucaagaaaaacucuguggaaucaggaacuauacauccagcaggacaacagugaaaggaagcguaagcacuugccggaucgccaggauggaccugcugcaaaguccgagaaggccgccccacgaagccagcacuggcugcaccgugaccuccggguuagguuuguggauaacauguacaaggggggacaguacuauaauacgaaaaugaucaucgaggacguccucagcccagacacaugcguuuguagaaccgacgagggacguguccuggagggacuuagagaagauaugcuggaaacauuaguucccaaggcggagggagaccgggugaugguugugcuaggaccacagacgggccgagugggacaccuucugucaagggaucgggcucgaagccgagcguuagugcagcucccccgcgagaaccaagugguagaacuccacuacgacgccauuugccaguacaugggaccaucggacacagacgaugauuag

SEQ ID NO: 26074 - RNA, 618 nt, Artificial Sequence
  Description of Artificial Sequence: Synthetic coding sequence
auggccgccgcggcggggggggcugccucucgccgaggagcggggcgccccuguccauuuaguauugagcacauauugucuucuuugccagagcggucucuaccugcccgugcugcguguccaccucaaccggcagggcgucagagcccugcuaagccugaagagcccggagcucccgaggcugcuccaugcgcgugcuguuguuguuguggcccuagagcugcgccauguggaccaccagaggccgccgcaggacuaggagcacgacuagcuuggccucugcgacucggacccgcuguaccacuguccuuaggcgcccccgcaggagggucuggagcacugccaggcgcagucggccccggaucccagagacguacaaggagacaucggacgauuuuuagcgaggagcaguuacaagcacuugaagcauuauuugugcagaaccaauaucccgaugucaguacucgcgaacggcuagcagggagaauacgacucagagaggagcggguugaggucugguucaagaauagacgggccaaguggcggcaucaaaaaagggcuucugcuagcgccagauuacuacccggugucaagaagucucccaagggcucuuguuag

SEQ ID NO: 26075 - RNA, 591 nt, Artificial Sequence
  Description of Artificial Sequence: Synthetic coding sequence
auggagaucauaucgucaaagcuguuuauucuccucacacuggcaaccucaucacuguugaccucaaacauauucugugcugacgagcuggucauuucaaaccugcacucgaaggaaaauuacgauaaauacucugaaccucgaggcuauccaaagggugagagaagcuugaauuuugaagaacugaaggauugggggccaaagaauguuaucaagaugagcacaccagcagugaauaaaaugccucauuccuucgcuaaccugccucuccgcuucggacggaacguacaggaggagagguccgccggagcaacagccaaucucccacugcguucuggcagaaauauggaagucagcuuggugaggagggugcccaaucucccucagcgauucggccggaccaccacagcuaagagugucugcaggaugcuuucugacuuaugccaaggguccaugcacucgccuugcgcaaacgauuuguucuacucaaugacaugucaacaccaggaaauacagaacccggaucaaaaacagagccgccgccugcuuuuuaagaaaauugacgacgccgaacugaagcaggaaaaauag

SEQ ID NO: 26076 - RNA, 2430 nt, Artificial Sequence
  Description of Artificial Sequence: Synthetic coding sequence
auggcuggugcagcugccgcggucgccgcaggugcggcagccggagcagccgccgccgcugugagugucgccgcuccugggcgcgccucagcucccccccccccuccuccaguguauuguguaugccgacagccuuaugacguuaaucgauuuaugauugaaugcgauaucugcaaggacugguuccacgggucauguguggggguggaggaacaucacgcuguggauaucgaucucuaucacuguccaaacugcgccgugcugcacggcagcucucuaaugaagaagaggcguaacuggcaccggcaugacuauaccgagauagacgaugguaguaagcccguacaggcaggcacuagaacauucaucaaggagcugcgcucucgagucuucccaagcgccgacgagauaauuauuaaaaugcaugggagucagcugacccagagguaccucgagaaacauggguucgacguuccaauuauggugccaaaacucgaugaucuuggacuccgccuuccuagccccacuuucagcgucauggacguggaaagauauguggguggggacaagguaaucgacguaaucgacguggcccggcaggcagacucuaagaugacucuccauaauuacguuaaauauuucaugaaucccaaucgaccaaaaguacuuaacguuaucagucuagaauucagcgauaccaaaauguccgaacuggucgaggugccugauaucgccaagaaacugagcuggguugagaauuauuggcccgaugauagcgucuuucccaagccuuuuguucaaaaguacugucucaugggagugcaagacagcuauaccgauuuccauaucgauuuuggggggaccagcgugugguaucauguccuguggggcgagaagaucuucuaccuuaucaagccaacugacgagaaucuugcccgcuacgaauccuggucaucuuccguaacccaguccgaggucuuuuuuggagauaaagucgacaagugcuauaaaugcguggugaagcaggggcauacacuguucguaccuacuggcuggauccacgcugugcugacaagccaggacugcauggcauucgggggcaacuuucugcacaaucuuaacaucgggaugcaguugagguguuaugaaauggagaaaagauugaagacgccugaucucuucaaauuuccuuuuuuugaagcuauaugcugguuugucgccaaaaaccugcucgagacauugaaagaacucagggaggacggauuccagccacagacuuaccuggugcaaggagugaaagccuugcacaccgccuuaaaacuguggaugaaaaaggagcuggucucugagcacgcauucgaaauccccgauaaugugaggcccggccaucugaucaaagagcucuccaaggugauaagagccauagaagaagaaaauggcaagcccgucaagucccagggcauucccaucguguguccugugucccggaguuccaaugaggcaacaucaccuuaucacucgagacguaagaugagaaagcugcgugaccacaacgugcgaaccccuucaaacuuagacauccuggagcuacacaccagagaggugcugaagcgacuagaaaugugcccgugggaagaagauauacugagcagcaagcugaacggaaaauuuaacaaacaccuucagccgagcuccacagugcccgaguggcgcgcaaaggauaacgaucuccggcuguuauugacaaauggaagaaucauuaaggaugagcgccagccuuuugcagaccagagucuguauacagccgacucggagaaugaggaggauaaacguagaacuaagaaggccaaaaugaagaucgaagagagcuccgguguggaaggaguugaacaugaggagucucagaagccacucaauggguuuuuuacacgcguuaagagcgagcugagauccagaaguucagguuacucagacauuagcgaaagcgaggacagcgggccagaauguaccgcccuaaaauccauuuucaccacggaagaauccgagucuucaggggacgagaagaagcaggaaaucacaucgaauuuuaaagaggaaucuaacgucaugcgaaacuuccugcagaagucccagaaaccgagccgcucugaaauaccaaucaaaagggaaugcccaaccaguacaucuacagaagaagaggcuauccagggcaugcuguccauggcaggucugcacuacucaaccugccugcagagacagauacagaguacugauugcaguggagagcguaacucgcuccaggacccuuccucaugucaugguagcaaccacgaggugagacaacuguaccgguacgacaaacccguggagugugaaacacgaucccaccucuguugcccggacuggucuccuaccccugagcucaaguag

SEQ ID NO: 26077 - RNA, 3291 nt, Artificial Sequence
  Description of Artificial Sequence: Synthetic coding sequence
augggcuccgaagaccauggggcucaaaaccccuccugcaaaaucaugaccuuccggccuacgauggaggaauucaaggauuuuaacaaguacguggcuuacauugaaucccagggagcgcauagggccggccucgcuaagauuaucccaccuaaagaauggaagccaagacaaacauaugaugauaucgacgacgucguuauacccgccccuauccagcaagucgugacggggcagagcgggcuguucacccaguauaacauacagaaaaaggccaugacagugggggaauaucgccgccuggcaaacagugagaaguauugcacaccacggcaccaggacuucgacgaucuggaacgcaaguacuggaaaaaccucaccuuuguguccccuaucuacggcgcggauaucagugggucccuguacgacgaugauguggcacaauggaauaucggcagucuucgcacaauucuugacaugguagagcgcgaaugcggcacaaucaucgaaggugugaauacaccuuaccuguacuucgggauguggaagaccacauuugcguggcacaccgaggauauggaucucuacucuauaaauuaucuacacuucggagagcccaaauccugguacgcuaucccuccugagcauggcaaaagacuggagcguuuggccaucggauucuuccccggauccucccaaggaugugaugccuuucuccgacacaagaugacacucaucucucccaucauucucaaaaaguauggaaucccuuucucacgcauuacacaggaagcgggagaguuuaugauuaccuucccauauggguaccaugcuggguuuaaccacggauuuaacugcgccgaaucuaccaauuucgccacccugagauggauugauuacgggaaggucgcuacacagugcacaugccgaaaggacauggugaaaaucucaauggauguauuuguucguauccugcagcccgagcgcuaugagcuauggaagcagggaaaagaucuuacugugcuugaccacacccgccccacagcccucacuagccccgaacuauccucgugguccgcuuccagggccagcuuaaaggcuaaacugcugcgcaggucucauaggaagcgcucacagccaaaaaaaccaaagccugaagaccccaaauuuccaggggaaggcacagcaggugccgcgcugcucgaggaagcgggagguuccgucaaggaggaggcaggucccgaaguggauccagaggaagaagaagaggaaccgcagccacugccucacgggcgcgaagccgaaggagcagaagaggacggcagaggcaaauuacggcccacaaaagccaagucugaaagaaagaagaaaagcuuuggucucuugccaccccagcuccccccaccuccugcucacuucccuuccgaagaagcccugugguugccaucccccuuggaacccccuguguuggggccugggcccgcugcaauggaggaaucaccccugccagcaccuuugaacgugguucccccggagguacccucugaggaguuggaagcaaaaccaaggccaaucauccccauguuauauguagucccacggccaggcaaggcugcguucaaccaggaacacgugucuugucagcaagccuucgagcauuuugcccagaagggccccacauggaaggaacccgucagcccuauggaacugacaggccccgaagauggagcagccuccucgggcgcuggccgcauggagacaaaggcucgagcuggcgaagggcaagccccaagcacauuuuccaagcuaaaaauggagaucaaaaagucuaggcgucauccccucgggaggccacccacuagaagcccucuuuccguuguaaagcaagaggcguccuccgacgaggaggccuccccuuucucuggggaagaagacgugucugauccagacgcacugcggccucucuuaagccugcaguggaagaacagggccgcauccuuucaggccgaacguaaauucaaugccgccgcugccagaacagaacccuacugcgccauauguacuuuguucuauccauacugucaggcccuccaaacagagaaggaagccccaaucgcaucacucggcaaagguugccccgcaacacucccaucgaagagcagacagaagacacgccccuuaauacccgagauguguuuuacgagcgguggggaaaacacugaaccccugccugccaacucguauauaggcgacgacgggaccucuccucugaucgccugcggaaaguguugcuuacaaguacaugcuaguuguuauggcauuagaccugaauuggugaacgaaggguggacauguucucggugugcugcccacgcuuggacugcugaaugcugcuuguguaaccugcgcggcggggccuuacagaugacuacagacaggagauggauccaugucaucugugcgaucgccguuccugaagcccgguuucugaacgugauugagcgccacccaguagacaucagcgcaauuccagaacagcgguggaagcucaaguguguguauugucgcaagaggaugaagaaggugagcggcgccuguauacaaugcuccuacgaacacugcuccacaagcuuucacgugaccugcgcacaugcugcaggcguauugauggaaccagaugacuggccauacgucguaagcauaacaugucugaagcauaagucagggggccacgcaguccagcugcuccgagcgguuucacugggccagguggucaucacaaaaaacagaaacggacuauacuauagauguagagugaucggugcagcuucacagaccugcuacgaagugaacuucgacgacgguucauauagcgauaaccucuaucccgaaucuaucacuagccgagacugcgugcaacuggguccucccuccgaaggagaacugguggaacuucgcuggaccgauggcaaccuguacaaggcuaaauucauuagcuccgugaccucacacaucuaccaaguggaguuugaagacggcucgcagcuuaccgugaaaaggggagauaucuucacccucgaagaggagcugccgaagcggguacguucucgccugagccucagcaccggcgcaccacaggagccugccuucaguggcgaagaggcuaaagcggccaagcgcccacgaguggggacccccuuggcuaccgaagauuccgggcgcucucaggauuauguggcuuucguggaaucccuccugcagguccagggucgucccggcgcgccauuuuag

SEQ ID NO: 26078 - RNA, 2289 nt, Artificial Sequence
  Description of Artificial Sequence: Synthetic coding sequence
auggaagggccacgauccucgacacaugugccauugguccugccgcuucuuguacuccuccugcucgcaccggcccgccaggcagccgcucagcgcuguccucaggccuguaucugugacaauucccguaggcacgucgcaugccgauaucaaaacuugaccgaagugccagacgccauuccagagcuaacccaaaggcuugaccugcaggguaaucugcucaaaguaauccccgccgcagcauuucagggaguaccgcaccugacccaucucgaucucagacacugcgagguugaauuggucgcggaaggcgcuuuuaggggccuggggcgccugcuacuguuaaaccucgcuaguaaucaucugagggagcucccccaagaggcacuggacgggcuggggagucuacggaggcuggagcuggagggcaaugcgcuugaagaguugaggcccggcacauuuggagcacugggugccuuggcuacccugaaccucgcucacaacgcccugguguaccugcccgcaauggccuuucagggccuguuaaggguccgguggcuuaggcuuagccacaacgcucucucugugcuggcacccgaagcuuuggcuggacucccugcccuacgucggcucucacuacaucacaaugaacuucaagcccugccaggccccguucuaagccaggcccgcggccuagcccggcuugaacuugggcacaacccacuuacauacgccggcgaagaggacggacuggcacugcccgggcugcgcgagcucuuacucgauggaggagcauugcaggcgcuugggccccgggcuuucgcccauuguccaaggcuacauaccuuggaucugcgaggaaaccaacuggauacgcugccuccacugcaagggccaggacaguugcggcgguuacgauugcaagggaacccacucuggugcgggugccaggcccgaccacuacuggaguggcuagcucgugcccguguacggagcgauggagccugccagggaccucggcgacugaggggagaagcccucgacgcccugagacccugggaucugaggugccccggggacgccgcacaggaggaagaggaacuggaagaacgagcaguugcuggcccuagggcucccccaaggggaccacccagaggccccggagaggagcgagccgucgcccccugcccacgcgcuugugugugcgucccagagucgcgucacuccuccugcgaggguugugggcuucaagcugucccacggggguuucccuccgauacacaacuucucgaucuccgaaggaaccacuucccaagcgugccacgcgccgccuuuccaggcuuaggccaucuggucucacugcaccuccagcacugcgguaucgcugaacuugaggcaggcgcccuagcuggacugggccggcucaucuaccuguaccucucagacaaccagcuagcuggauuaucggcagcugcgcucgagggagcccccagauugggcuauuuguaccuugaacguaaucgcuuccuucaagugccuggugcggcccuccgcgcccuuccgucccuguuuagucuccauuuacaggacaacgccgucgaucgccuggcuccuggcgaccucggccggacgcgugcucugagauggguuuaccugucaggaaauagaauuacagagguuucccugggugcacuagguccagcacgugagcuggaaaaauuacacuuggaucggaaccaacucagagaggucccgaccggugcccuggagggccuccccgcccuguuggagcuccagcucaguggcaauccccugcgcgcccugagggacggugcguuccagccaguaggcagaucauugcagcaucucuuucucaauucaucugggcuggagcaaaucugccccggagccuuuagcggcuugggaccuggacuccaaucauugcaccuccagaagaaucagcugcgugcauugcccgcuuugccaucguuaucacagcuggaacucauagaccucaguucaaauccuuuccauugugauugucagcuacugccgcugcaccgauggcucacuggguuaaacuugagaguaggagcaacuugcgccaccccaccuaacgcaagagggcagcggguaaaggccgcggccgccguuuuugaagauugucccgguugggccgcccguaaggcuaagaggacuccggcaagccgaccaagcgccaggaggacgcccaucaagggaagacaguguggugccgauaaggugggcaaagaaaagggccgacucuag

SEQ ID NO: 26079 - RNA, 1059 nt, Artificial Sequence
  Description of Artificial Sequence: Synthetic coding sequence
auggcucccaaguugauuaccgugcugugccuuggauucugccuaaaucagaagauuugcccucaugcuggcgcccaggacaaauuuucauuguccgcuuggccaucccccguagugccacuggguggccgcgugacccuguccugucauucccaucucagguuuguuauuuggaccauauuccagacaaccggaacacgcucucaugagcugcauacagggcucucuaacaauaucaccauuucuccagucacaccagaacacgccggcacguaucgcugugucgggauuuauaaacaugcuuccaaauggagcgcugaauccaacucuuuaaaaaucaucguuaccggacucuucacuaagccuuccaucuccgcucaucccagcucuuuagugcacgcaggugcgagaguuucguugagaugucacucggaacuggcauucgacgaauucaucuuauacaaggagggccauauucagcauucucagcaguuagaucagggcauggaagcgggaauucacuacguggaggcaguguuuagcaugggaccagugacacccgcccacgcuggcgcauacagaugcugcgguuguuuuucccauagcagauaugaaugguccgccccauccgacccgcuugacaucgugauuaccgggaaguacaagaagccuagccucuccacacaagucgacccaaugaugaggcuuggagaaaagcugacccucuuuuguuccagugaaauuucguuugaccaguaccaccuguuccggcacggcgucgcccauggacaguggcuuagcggcggacagcgccauagagaggcauuccaggcaaacuuuagcguuggacgggccacacccguccccgguggcacuuaucgguguuauggcuccuucaaugacucaccauauaagccaccugugaccagguguaacuucacaccucaagaaacucugaggguccuucugugccauagucagaacccaccccugaauuuaacacaccuggcacuuaaagauuccccggccaccuguaucuguucucucgacucacaauag

SEQ ID NO: 26080 - RNA, 624 nt, Artificial Sequence
  Description of Artificial Sequence: Synthetic coding sequence
auggcaggaccugccacucagaguccuaugaaacuuauggcucuacagcuucugcuauggcacagcgcgcuguggacagugcaggaggccaccccgcucggacccgccucuucccuaccccaaucuuuuuuacugaaaugccuggaacaggucagaaagauacagggcgauggcgccgcucugcaggaaaaacuagugucugaaugugcgaccuacaaacucugccaucccgaagaauuaguucugcuuggucacagcuugggcauucccugggcaccccucuccuccugucccucacaggcuuuacagcuggccggcugucucagucaacuacacaguggucucuuuuuauaucaggggcuccugcaggcuuuagaggguauuagccccgaacucggcccuacucuagacacucugcagcuggacgucgcagauuucgcaacgacuaucuggcaacagauggaagagcuaggcauggccccggccuugcaaccaacccagggagcaaugcccgcuuuugccagugcguuccaacggagggcaggcgguguuuuaguggccucacauuugcagaguuucuuagaagugagcuaucgcguacugagacaccuagcacaaccauag

SEQ ID NO: 26081 - RNA, 1476 nt, Artificial Sequence
  Description of Artificial Sequence: Synthetic coding sequence
augaagaccuucaccuggacccuaggggucuuguuuuuucugcuaguugauacaggccacugccgggggggacaguucaagaucaaaaaaauuaaucaaaggagauacccaagggccaccgacggcaaggaagaagccaaaaaaugugcguacacuuuccugguaccugaacagcgcauaaccggacccaucugugucaacacuaagggccaggaugccagcacaauuaaggacaugaucacuagaauggaucuggaaaaccugaaggacguguuaucacgccagaagagagaaauugacgugcuucagcuuguagucgaugucgacgggaacaucgugaaugaggugaaacuuuugaggaaggagucaaggaauaugaauagcagggucacacagcuguacaugcagcuguugcacgagauaauacguaaacgggauaauucuuuagaacuuucccagcuggaaaacaaaauucugaaugucacgaccgagauguugaaaauggcaacucgguaccgagagcuggaaguuaaguaugccucccuuaccgaucugguuaacaaucaaucuguaaugauaacccuucuagaagaacagugucuccgcaucuuuagcagacaggacacucaugucucaccuccuuuaguccaggucgugccacaacauauacccaauucucagcaguacacccccggacuccucgguggcaaugagauccagagggauccagguuacccuagagauuugaugcccccgcccgaucuggcaacaagucccaccaagaguccauucaaaauaccccccgugacuuucaucaaugaagggcccuuuaaagauugucagcaagcaaaagaggccggccacucugugucagguaucuauaugauuaagccagagaacuccaauggaccaaugcaacuauggugcgaaaauucacucgaccccggcgguuggaccgugauucagaagcggacagaugguucaguuaauuucuucagaaacugggaaaacuauaagaagggauuuggcaacauugacggggaguauuggcuggggcucgagaacaucuacaugcugucuaaucaagauaauuauaagcuccuuaucgaguuggaggauuggagugauaaaaaagucuacgccgaauauuccagcuuuagacuagaaccagaaagcgaguucuauaggcugaggcuugggacauaucagggcaaugcuggcgacucuaugauguggcacaacgguaagcaauucacgacacucgaucgcgauaaggauauguaugccgggaacugcgcacacuuccauaagggaggguggugguauaacgcaugugcccacucaaauuugaauggugucugguauaggggaggccauuacaggagcaaacaucaagaugguauauuuugggcugaauacagaggggguucauauuccuuaagagccgugcagaugaugaucaaacccauugacuag

SEQ ID NO: 26082 - RNA, 1833 nt, Artificial Sequence
  Description of Artificial Sequence: Synthetic coding sequence
auggacgaugacaagcccuuucaacccaaaaauauaagcaagauggccgaguuguucauggagugugaagaggaggagcuggaaccauggcagaaaaaaguagaggaaacccaagaugaagaugacgaugaacucauuuuugugggagaaaucuccucaagcaagccagccaucagcaacauucugaacagaggucacucuucuaguuccagcaaaggcauuaaaagcgaaccgcauagucccggaauuccagagauuuucagaaccgccagccagcgcugccgggauccucccagcaaucccguugcagcaucccccagguuccaccuggugagcaaguccucucaaagcucugugacugucgagaaugccucgaaacccgauuucaccaagaacucccaggucggcucagacaauaguagcaucuugcuauucgauagcacucaagaaagccuuccaccuucccaagacauuccagcaaucuuccgcgaggguaugaagaauacuucguauguccugaagcauccgagcacaucuaaaguaaacucagucacaccaaagaaaccuaagacuagugaagacguaccacagaucaaccccaguacaucacugccacuaaucgguucaccuccugucaccuccucccaggucauguugucuaaaggcaccaauacuuccucuccuuacgaugcuggagcugacuaccugcgcgcgugccccaaaugcaacguccaguucaaucuacuggacccccugaaauaccacaugaaacauuguuguccugacaugauuacuaaauuuuugggaguuauagugaaaagcgagcguccuugcgaugaagacaagacugauucugaaacuggcaaguuaaucaugcuagucaaugaguuuuauuacggccgccaugaaggcgugacugagaaagaacccaagaccuacacaaccuuuaaguguuucucauguaguaaaguauugaaaaacaacauucgguucaugaaccauaugaagcaucaccuugagcuagagaagcagaacaaugaauccugggaaaaucacacaaccugccaacacuguuacaggcaguaccccacuccuuuccagcuccagugucacauagaaaguacccauacgccccaugaguuuagcacaaucugcaagauuugcgagcucagcuuugaaaccgagcacauucuucugcagcauaugaaggacacucacaaaccuggugagaugccguauguaugccagaaaaaaggcguucaccguugcccuaaaugcagacuacaauuccucacguccaaagagaaagcugagcacaaggcccaacaccgaaccuuuaucaaaccuaaagagcucgagggguuaccgccaggcgccaagguuaccauaagggcaucacucggcccgcugcagagcaagcuccccaccgcuccauuugguugcgccccugggaccucuuuuuugcaggugacgccccccaccagucaaaacacuacugccagaaacccucgcaaaucuaacgccagcagaagcaagacuuccaagcugcaugccacuacauccacagccaguaagguuaacaccagcaaaccccgagggaggaucgcaaagaguaaagcuaagccauccuauaagcagaaacgacagaggaaccgaaaaaauaagaugucccuugcgcugaaaaauauccggugucguaggggcauucacaaauguaucgaaugucacagcaagauuaaagauuucgcuucacacuuuagcauauauauucauuguuccuucugcaaguacaauacuaauuguaacaaagcauucgugaaucacaugauguag

SEQ ID NO: 26083 - RNA, 1083 nt, Artificial Sequence
  Description of Artificial Sequence: Synthetic coding sequence
augcccgagcuaguggugacugcauugcuugcuccaagucgccugucccuaaaauuauugcgggcuuuuauguggucuuugguuuuuuccguggcucuugucgccgcagcagucuauggaugcaucgcgcugacucacguacucugcaggccaagacgcgguuguuguggccggagaaggagugcuucaccugcuugucugucagaucccagucucggugaacaugguuuucugaacuuaaaauccuccgggcuucgucugcacuacgucagcgccggaagagguaaugggccacucaugcuauuucugcacgguuucccagaaaauugguucuccuggcgauaccagcuccgugaauuccagaguagguuucaugucguggcuguggacuuaaggggcuacggcccuucagacgcuccucgcgaugucgacuguuauacuauagaccuccuucuggucgacauuaaggauguuauucuaggacuggguuauagcaaguguauucuggucgcacacgacuggggcgcacuguuagccuggcacuuuucgauuuacuauccuucccugguugaaagaauggucgucgugagcggugcuccaaugagcgucuaccaggacuacucacugcaucauaucagccaauuuuuuagaucccauuacauguuucuuuuucaguuaccauggcuccccgaaaagcuccuuucaaugucggacuuccaaauucuuaagacaacuuugacucauagaaagacuggaauccccugucuaacaccuagcgagcucgaggccuuccuuuacaacuuuagucagccugguggccucaccggaccacuaaacuacuaucgcaaucuauuccgaaacuucccacuggagccucaagaacucacgacgccaacacuuuuacucuggggcgaaaaggauacguaucuggagcuggggcugguggaggcuaucgggucgcgauuugugccggggcgucucgaagcucauauauugcccgguauuggucacuggaucccucaguccaauccacaggaaaugcaucaguauaugugggcguuccuacaggaucuacuggacuag

SEQ ID NO: 26084 - RNA, 16218 nt, Artificial Sequence
  Description of Artificial Sequence: Synthetic coding sequence
augggagcccuguggucaugguggauuuuaugggcaggcgcuaccuugcuguggggauuaacccaagaggcgagcguggaucugaagaauacugggcgcgaggaauuuuuaaccgcauuucugcagaacuaccagcuggccuauagcaaggccuacccccgccuauuaauauccuccuuguccgaaucaccagccuccgucaguauccugucucaggcagacaacacaagcaaaaaggugacggugcggccuggcgaguccgugaugguaaauauuagugcaaaggccgagaugaucggcucuaagauuuuccagcacgccguggugauucauagcgacuaugcgaucuccguccaggcucugaacgcaaagcccgauaccgcagagcucacccugcuacguccuauucaggcacuugggacugaguacuucguucugaccccuccugguaccuccgcccggaacguaaaagaguuugcugugguggccggugcggcuggcgccuccgugagcgugacccuuaagggcuccgugacauuuaacgggaaguucuacccugcgggcgacgugcuccgaguuacccugcaaccuuacaacgucgcccaguugcaguccucaguggaucucagcggcucaaaggugacggcuagcucaccuguggcagugcugucgggccauagcugugcucagaagcauacuacauguaaccacguggucgagcagcuguuacccaccucugccuggggcacccacuaugucgugccuacucuggcuucucaaucuagguacgaccuggccuuuguuguggcuucgcaggcuacaaaacuuacuuauaaccauggcgggauaacuggaucgcguggacugcaggcaggcgauguuguggaguuugaggugagaccauccuggccuuuauaucucucagccaacgucggaauccagguucuucuguucgggaccggagcaauuagaaaugaggucacauacgauccuuaucuggugcuaauucccgauguugcggccuauuguccagccuacguagugaagucagucccuggcugcgagggcguggcgcuuguaguggcccagacgaaagcuauuagcggccugaccauugacggacaugccguuggcgcuaagcugaccugggaggcugugcccggaagcgaauucagcuaugcagagguggagcugggcacugccgauaugauacauacugcagaggcgaccaccaaucuuggacuccuaacuuuuggacuggcgaaggcuauuggguaugcaacagcagcagacugcggucgaaccguucuuaguccgguggaaccuaguugcgagggaaugcaaugcgccgcaggacagaggugucaaguggucggaggcaaagcaggauguguggcugaaucuaccgccguuugccgggcucagggcgacccccacuauacuacuuucgacggccgacgguacgacaugaugggcacuuguucuuacaccaugguggaacucuguucugaggaugauacgcuccccgccuucucuguagaggcuaagaacgaacacaggggcucaagaagaguuagcuaugucggccucgugaccgucagagccuauucccacagcgucucucuaacaaggggggaaguaggcuuugucuuaguggauaaucaacgcaguagacugcccguguccuugagcgaaggcaggcuccgagucuaccagagcgggccccgggccgugguggaauuaguuuuuggccuggugguaaccuaugauugggacugccagcuugccuugucacugccagcuagguuccaagaucagguuugcgggcuuuguggaaacuacaacggagauccugccgaugacuuccucacacccgacggcgcucuggccccggaugcuguggaguuugccaguucguggaagcucgaugacggcgauuaucucugugaggacggcugucaaaauaacuguccagcgugcacccccggccaagcucagcacuaugagggugaccgguugugugguaugcuuaccaaacuggacggcccuuucgcugugugccaugauacccucgauccccgacccuuccuggagcaguguguuuacgaccuguguguggucggcggagagcgccugucacugugccgaggccugucugccuaugcccaggccugccuggagcuaggcauuagugucggagacuggagaucucccgcuaacuguccacugucgugucccgccaacucgcgguaugaacuaugugggccagccugcccaacgucauguaauggcgccgccgcccccaguaauugcuccgggaggccauguguggagggcugcgugugucugccaggcuucgucgccuccggaggagcaugcgugcccgcguccucaugcgggugcacuuuucaggggcugcaguuggccccuggucaggaagugugggcugaugagcugugucagcgcagguguacuuguaauggcgccacucaccaggugacuugccgggauaaacaguccugccccgccggggaaagaugcucgguacagaacggauugcucggcugcuacccugaucgcuuuggcacaugucagggcuccggggacccucacuacguuucauucgaugggcgcagauuugacuuuauggguacaugcacauaucuccugguggguucaugcggccagaacgcugcccuaccagccuuuagagugcuuguggagaacgagcaccgugguagccaaacugucagcuacacccgggccguucgggucgaagcccguggcguuaagguggccguccggcgcgaguaucccgggcaggugcuggucgacgacguguugcaguauuuacccuuccaggccgccgacggacagguacaaguuuuucgucagggacgagaugcagucguucguacagacuucggucuuacgguuaccuaugauuggaaugccagagugacagcuaaggugcccucuuccuaugcagaggcccuguguggccuaugcggaaauuucaauggugauccagccgaugaccuugcccuccggggagguggucaggcagcuaaugcccucgcguuuggaaacucauggcaggaggaaacaagaccaggaugcggagcaaccgagcccggcgacugcccuaagcuggauucucugguggcucagcaacuccaaucuaagaaugagugcgggauccucgccgacccuaaaggacccuuucgcgagugccacaguaagcuugacccucagggcgcagugcgagacuguguuuacgauagaugccuccuaccuggacaaucuggcccccugugcgaugcgcucgcuacuuacgcggccgccugccaggcggccggcgccacaguucacccuuggaggagcgaagaacuaugccccuugagcugcccuccacauucgcacuaugaggcaugcuccuauggcugcccgcugaguugcggcgacuuacccgugccuggagguugugguucagagugccaugagggcugcguuugcgacgaaggguuugcucugucgggcgagucaugccugccacucgcaagcugcggauguguccaccagggaaccuaccaucccccaggacagaccuucuauccaggacccggaugugauucucugugccauugccaagaggggggauuggugagcugugagaguucauccugugggccgcaugaggccugccagcccucagguggcucuuugggaugcgucgccguuggcagcuccacuugccaagcuucaggcgacccucauuacacuacauuugaugguagaagguuugacuuuaugggcacaugcguguauguuuuggcgcagaccugcgguacccgacccgggcugcaucgcuucgcaguccuccaggagaauguggcaugggguaacggccgcgugagcgugacccgcgugaucacagugcaaguggcgaacuuuacacucaggcuggaacagagacaguggaaaguuacggugaacggcgucgauaugaagcuucccgugguccucgcaaacggucaaauaagagccagccagcacgggucagacgucgugauugagacugauuucgguuugcgaguugcuuacgauuugguuuacuauguucgcgugacggugcccggaaacuacuaucagcagauguguggucucugcggcaacuauaacggcgaccccaaagacgacuuucaaaagccaaaugguucccaggccggaaacgcuaaugaguucggaaacaguugggaagaaguugugccagauuccccgugucucccuccuaccccaugcccuccugggucagaggacugcauuccaucccacaaauguccaccugaauuggagaagaaguaucagaaagaggaguuuugcggacugcuguccucacccaccggaccucugagcucaugccauaagcucguggacccucagggaccgcugaaagauugcauuuucgaccugugccucgggggggguaaccugucuauacugugcaguaauauacacgccuacguuucugcaugccaggcggcuggaggccauguggaaccuuggagaacugagacguucugccccauggaaugccccccgaacucucauuacgaacuuugugccgacacuuguucccugggaugcagugcccucuccgccccaccccaaugccaggaugggugugcggagggaugccaaugugacucaggguuucuauauaaugggcaggcuuguguaccaauccagcaaugcgguugcuaucauaauggcguuuacuacgagccugaacagacuguacugauugauaacugcagacagcagugcacaugucaugcgggcaagggcauggugugccaggagcacagcuguaaacccggucagguaugccaacccagcggcggaauccuuuccugcguuacgaaggacccaugucacggcgugaccugcagaccucaggagaccuguaaggagcaaggaggccaaggagucugcuugcccaacuaugaggcgaccuguuggcuguggggcgauccacauuaccacucuuuugacgggcguaaauucgacuuucaggguacgugcaacuacguacuggccacaacugguugcccuggagucuccacucaaggacuuaccccuuuuacaguuaccaccaaaaaccagaaccggggcaacccagcagugucauaugugcgggucguaacagucgccgcucuagggaccaauauuucuauucauaaggaugaaaucggaaaaguccgcgucaaugguguguuaacugcacugccugucagugucgcugauggaagaaucucugugacacaaggagcuagcaaggcacugcugguggcugauuucgguuugcaagucaguuaugacuggaauuggcggguugacgugacacuaccaagcaguuaccacggcgccgucugcggccucuguggaaauauggauaggaaucccaauaacgaccaggucuuucccaacggcacccuggccccuaguaucccuaucugggguggcagcuggcgugcccccggcugggacccucucugcugggaugaaugcaggggcagcugcccgaccugcccggaggaccgguuggagcaguacgagggccccggcuuuuguggcccucuggcccccggcaccggcggaccuuucacuacgugucacgcucauguccccccagaaaguuucuucaaaggcugcgugcuugacguguguaugggcggcggggacagagacauccuuugcaaagcccuagcuucuuacgucgccgcaugccaagcugcaggcgucgugaucgaggauuggagagcccagguaggaugugagaucacguguccagagaacagccacuacgaagugugcgggucuccuugcccagcaagcuguccuagcccggcuccuuuaaccaccccagccgugugcgagggcccuuguguggaaggcugucagugugaugcuggguucguacugagcgccgacaggugcgugccacugaacaauggguguggcugcugggccaauggcacauaccacgaggccgguucugaguuuugggccgacgguacaugcagccaguggugucggugcggcccaggagguggcuccuuagugugcacuccagccucgugugggcugggggaggucugcgggcuccugcccucugggcagcacggcugucaaccaguguccacugccgaaugccaggccuggggagauccccauuaugugaccuuagacggucaccgauuuaauuuccaaggcacgugcgaguauuugcuaucggcuccuugccauggcccaccucuaggcgcugagaauuucaccguaacaguugcaaaugagcaccgugguucacaggcgguuucguacaccaggagcguuacccuccagauuuacaaucauucucucacacuguccgcccguuggccucggaaacugcagguggauggcgucuuuguaacucugcccuuucagcuagacucucuccuccaugcccaccuuucgggugccgacguggucguuacuacgacauccggucuuucucuggcauucgacggggauaguuuuguacggcugagagucccagcagcguacgcuggcucucugugcggacuaugugggaacuacaaucaggacccggccgaugaucugaaagccgucggcgguaaaccagcuggauggcaggugggcggcgcccaaggaugcggggagugcgucagcaagccuugucccagcccgugcacaccugaacagcaggagagcuucggcggcccagacgccugcggcgucaucuccgcuacagauggaccgcucgcucccugucauggccucgucccacccgcccaguacuuccagggaugccugcuggacgcuugucaagugcagggacacccggggggacucugcccggccguggcuaccuacguggccgcuugccaagccgccggagcucaacuuagggaauggcggaggccggauuuuugcccguuucaguguccugcccauucccacuaugaacuuugcggggauagcugcccagggucaugucccagcuuaucugcccccgaagggugugagucagcuugcagagaggggugcgucugcgacgcgggcuuugugcugucaggugauacgugcgucccugucggacagugugggugcuuacacgaugacagauacuauccucucgggcagacuuuuuacccugggcccggaugugacucccugugccguugccgagaagggggcgaggucucuugugagccuucaucuugcggaccccacgaaacguguaggcccagcggcggcucccuuggcugcguggcgguuggaaguaccacaugucaggcuucaggggacccacacuauaccacauuugacggacggcgcuuugacuuuauggggaccuguguguacgugcuggcacagacguguggcacuaggcccggccugcacagguucgccgugcugcaggaaaacguugcaugggguaaugggagaguuucaguuacacgugugaucacaguucagguggcuaacuucacuuuaaggcuggaacagcggcaguggaaggugacugugaauggcgucgauaugaagcugccagucguguuagcuaacggccagauucgggcuucucagcacggaucugacguugugauagaaaccgauuucggacucaggguugcauaugaucuuguauauuacgugcgagugacggugcccggcaauuauuaccaguuaauguguggccuguguggaaacuauaauggcgauccuaaagaugauuuccagaagccuaauggcucgcaggcgggaaaugccaacgaauucggaaauucaugggaggaggucgugccggacuccccuugccuaccacccccaacuugcccaccuggauccgagggcuguaucccgagugaggagugcccgccugagcuggagaaaaaauaccagaaggaggaauucugcggguuacuguccagccccacagggccccuaaguuccugccacaagcuuguagacccccagggcccccugaaagacugcaucuucgaucugugcuuaggaggcgguaacuugagcauucucugcaguaauauucaugccuauguaucugcaugccaagcugccggaggccagguagagcccuggagaaacgaaaccuuuugcccaauggagugcccucaaaacagccacuaugagcugugcgcugauaccugcucccucgguuguucugcacugagcgccccacugcagugcccagacggaugcgccgagggcugccaaugcgacagcggcuuuuuauacaauggccaagcgugugucccgauccagcagugcggauguuaccacaauggagccuacuaugagccagaacagacugugcugaucgauaacugucggcagcaauguacuugccacguugggaaagugguggugugccaggagcauucauguaaacccggacaggucugccaacccagcggugggauccucucuugcgugaacaaagaucccugucauggagugacaugcagaccgcaagagacgugcaaagagcagggcggccaaggcgugugucugccaaacuacgaggccaccuguuggcucuggggcgacccacacuaucacuccuucgauggucggaaauucgauuuccaagggaccugcaacuacgugcucgcuaccacaggaugcccuggugugagcacucagggccugaccccuuuuaccguaaccacaaagaaucagaacagggggaaccccgccgucuccuauguuagaguggugaccguagccgcccucggaaccaauauuaguauccacaaagacgaaauugggaaggugcgagucaacgguguucugacugcgcugccuguguccguagcagacggacguauaagugugacccagggcgcgucgaaggcccuccuggucgccgauuuuggcuugcaggugagcuaugacuggaauuggagagucgacgucacccuuccgaguucuuaccacggcgcugugugcggucugugcggcaauauggacaggaaccccaacaacgaucagguuuucccaaacggcacuuuggcaccuucaaucccaaucuggggcggauccuggagagcaccugggugggauccacuuugcugggacgaaugcagaggcuccugcccaacuuguccggaggacagguuggaacaguacgaaggcccuggguucuguggaccccuggcuccgggcaccggaggcccuuucacuaccugucacgcccacgucccucccgagucuuuuuuuaaggguugcguucuggaugugugcauggguggcggugacagagacauucuguguaaagcucuggcaucuuauguggcggcaugucaagccgcaggcgugguuauugaagauuggcgagcucaggugggcugcgagauaacaugccccgaaaauucccacuaugaggugugcggacccccuugucccgcaucuugcccuucuccugccccacucacaacacccgcggucugcgagggcccaugcguggaaggaugucaaugcgaugccggauucgugcuuagugccgaucgcugugucccacugaacaaugguugcggauguugggcgaacgguaccuaucaugaagcugggagcgaauucugggcugaugguacguguucccaguggugcaggugcggccccggcggggggagucucgugugcacuccggcuagcugcggccuaggugagguuugcggacuccucccuucaggacagcacggcugccagcccgucaguaccgcugagugccaggcauggggggauccacauuacgugaccuuagacggccaucguuucgacuuccagggcacgugcgaauaccugcuguccgcucccugucaugguccuccacugggcgcugaaaauuucacugucacuguggcuaacgagcaucgcggaagucaggccgugagcuacacccgcucagugacccugcagaucuauaaucauucacugaccuuauccgcacgcuggccaaggaaacugcaaguggauggcguguuugugacuuuacccuuccagcuugauagcuuacuccaugcccaucuguccggagcugaugucguggugaccacaacaucagggcugagucuggcuuucgacggcgauuccuucgugagauugaggguuccugcugccuacgcuggaucguugugcggacugugcggcaacuacaaucaggaccccgccgacgaucugaaggcuguugggggcaaacccgcagguuggcaggucggcggagcccaggguuguggcgaaugcguuucuaaaccauguccaucgccauguaccccggagcagcaagaaucauuuggugggccagaugcaugcggcguuauuuccgcuacagaugguccucuagcuccgugucauggccuugugccgccugcccaguauuuccaggguugccuacuggaugccugucaaguccaaggccacccugguggauuauguccugcgguggccaccuauguggcggcuugucaggccgcaggggcucagcugcgagaauggcgcagacccgacuuuuguccguuccaguguccagcccacagccacuaugagcuauguggagacucgugcccuggguccugccccagccucucugccccagaaggcugcgagagcgccugccgcgagggaugcgucugugacgcgggauucguacucuccggcgacacgugcguuccuguuggccagugcggauguuuacacgacgaccgcuacuacccguuagggcaaacguuuuaucccggaccgggcugcgauagucugugucguugucgcgagggaggugaggugucuugugagccuagcucuugcggcccucacgagacgugcaggccuaguggggguucccuugggugugucgccgucggaagcacuaccugucaggcuaguggagauccccacuauaccacauucgacgggcaccgauuugacuuuauggggacgugcguguauguucucgcccagacuugugggacccggccgggccugcaccgguuugcuguuuuacaggaaaacguggccugggggaaugguagagugagugugacacggguuaucacugugcaaguggcaaacuucaccuugcgcuuagagcagcgccaguggaaagugacagugaacggugucgacaugaagcuacccguggugcuggccaacggacagauacgugccagucagcauggauccgauguggugaucgagacugacuucgggcuuagaguugccuaugaccugguuuacuaugugcgagugacugugccagggaauuauuaccagcucaugugcgggcugugcggaaacuauaauggcgaccccaaagacgacuuucagaaacccaaugguucucaagcugggaacgcuaaugaauucgggaauaguugggaggaaguggugccugauucucccugcuuaccgccacccacguguccccccggcucagcuggcugcauccccagugauaagugcccuccugagcucgagaagaaguaccagaaggaggaguucuguggccuucuuucuucgccaaccggaccucucaguagcugccacaaguuggucgauccgcaaggaccacugaaggacugcauauucgauuuaugucuggggggugguaaucuaagcaucuuguguagcaauauccacgcuuaugucucugcaugccaggcagcaggcggucaugucgagccuuggagaaaugagaccuucugcccaauggaauguccacagaacagucacuaugaguugugcgccgauaccugcucccuggggugcucagccuuaagcgcacccuuacagugucccgauggcugugccgagggaugccagugcgacuccggauuccuguauaauggacaggcuugcgucccgauccagcagugugguuguuaccacaaugguguauauuaugagccagaacagacugugcuuaucgauaacuguaggcagcaaugcaccugccacguggguaaaguuguggucugucaggagcacucguguaagccagggcaggugugccaaccuagcggggggauucuaaguugcguuacgaaagacccuugccacggugugaccugcaggccucaggaaaccuguaaagagcagggugggcagggcgucugucugccaaauuaugaagcaacguguuggcuguggggggacccucacuaucauucauuugacggcaggaaguucgauuuccagggcacuugcaauuacguccuagcaacaacgggaugucccggggugucaacacagggacugaccccuuuuaccgucacuacuaaaaaccagaaccgagggaauccugccgugucauauguuagggugguaacaguggcggcacugggaacaaauauuucaauccacaaggaugaaaucggaaagguccgugugaacgggguccugaccgcccuucccgugaguguggccgacggucguauuucuguagcccagggcgccuccaaagcccuacuugucgccgauuuuggccuccaggugagcuacgauuggaacuggcggguugacguaacauugccuagcagcuaccacggagccguaugcggcuugugugggaacauggaccgcaauccuaacaaugaccagguguuucccaacggcacguuggcuccuucaaucccuaucugggggggaagcuggagagcacccggaugggacccacugugcugggaugagugccgcggcucuuguccaaccuguccagaagaucgccuggagcaguacgaaggcccuggauucugcggcccccuuuccucaggcacuggugggccauuuaccaccugucaugcacacgugcccccagaauccuuuuuuaagggaugcguauuagaugugugcaugggcggcggcgaucgcgauauccucugcaaagcuuuggcuucguauguggccgcaugccaggcagccggggucgugaucgaagauuggcgcgcgcagguagguugcgaaaucacguguccggaaaacucacacuaugaagugugcggaccgccaugucccgcaucuugcccuucacccgcuccccucacuaccccugccguuugugaaggccccugcgucgaggguugucagugugaugcuggauucguacugucugccgauagauguguuccccugaauaauggguguggcuguugggccaauggaacauaccaugaagcagguagugaguucugggccgacgguacaugcucccaguggugucguuguggacccgggggggggucccuuguguguaccccugcauccuguggauugggcgaggucugcggcuuacuuccuagcggacagcaugguugucaaccugugucaacugcugagugccaagcuuggggggacccucauuaugugacccuggacgggcacagauuugacuuucaggguaccugugaguauuugcugagugcaccuugccacggacccccacugggggcagagaauuucacaguuacgguggcaaaugagcauagaggcucucaagcagugucuuacacccggucagucacauuacagauauauaaucacaguuugacccuuagcgcucgguggccacgcaaacuccaagucgauggcguguucguggcacuuccauuccaguuggacucucugcuccacgcccaccucuccggagcugacguggucgugaccaccacauccgggcuaucacucgcuuucgauggagauuccuucguccgucugcgaguucccgcugcuuacgcugccucucuguguggccuguguggcaacuacaaucaggacccagcagaugaccugaaggcugugggugguaagccugcgggauggcagguaggaggagcccaggguuguggggagugugugucgaagccaugucccuccccauguacuccugagcagcaggagagcuucggcggaccggacgcguguggugugauuagugcuaccgauggcccgcuggcaccuugucauggucuggugcccccagcccaguacuuucagggcugcuugcucgaugccugucaagugcaaggacacccaggaggauuauguccugcugucgccacguacguggcagcgugucaggcagccggagcccagcucggugaguggcggcgaccugacuucugcccucugcaguguccugcgcacucucauuaugaauugugcggagauagcugcccagugucuugucccucccuuagcgccccagaagguugugaguccgccugcagggaggggugugucugcgacgccggauucgugcuguccggagauaccuguguucccguuggacaaugugggugucuccacgauggccgguauuaucccuugggagaaguguucuaucccgggcccgagugugaaagaagaugcgaguguggaccuggcgggcaugugaccugccaagagggagcggccugcgggccucaugaggagugcaggcuggaggauggagugcaggcuugucaugccaccggaugcggccggugccuugccaaugggggaauccacuacaucacacucgauggacgcguuuaugacuugcacggcagcugcagcuacguucuggcucaggugugccacccaaagcccggcgaugaagauuuuaguaucgugcuggagaaaaaugcugccggugaccugcaacgccucuugguuacuguggccgggcagguggugucucucgcgcaagggcagcaggucacaguugacggcgaggccgucgcgcugccuguggcuguggggcgcguucguguuacagcugaaggucggaacauggugcuucagacuaccaagggccugaggcuucuuuuugacggcgaugcucaccuccugauguccauaccaagcccguuccgugguagguuauguggacugugcgguaacuuuaaugggaacuggagugacgauuucgugcugccuaacgggucugcugcaaguucaguggagacuuuuggcgcagcauggcgcgccccuggaagcagcaagggcugcggagagggaugcggaccccaggggugcccagugugcuuggccgaggaaacugcgccauacgagucuaacgaagccuguggacagcugcgaaacccucaggggccuuucgccacaugccaagcuguguugucgcccuccgaauauuucagacaaugcguguaugaucuuugugcccagaagggggacaaggcauuccucugucgcaguuuagccgcguauacugcugcgugccaggcugcgggggucgcuguuaagcccuggcgaaccgauuccuuuugcccccugcacugcccagcccauucccauuauucgaucugcacccgcaccugccagggcucaugcgcagcccucuccggacugacagguugcacaacgcgguguuuugaagggugcgaaugcgacgaccgguuucugcuaucucaaggggugugcauucccguccaggacuguggauguacacacaauggccguuaucuuccagugaauuccagcuugcugacaagcgacugcagcgaacgguguagcuguagcaguucaucuggacuuaccugccaagcugcugguugcccuccgggaagggugugugaagucaaagcagaggcccgcaacugcugggcuacccgugggcuguguguguugucagugggagcuaauuugaccacuuuugacggcgcaaggggcgccacuaccagccccggcguuuacgaacugucaagcaggugccccgguuuacagaauacgauuccaugguaucgugugguggccgaggugcagauuugucacggaaagacugaagcugugggccagguccacauuuuuuuucaagauggcauggucacccuuacacccaauaagggcgugugggugaacggacucagaguagaucucccggcugaaaaacuggccucaguuagcguguccaggacuccugacggaagucuccuugucagacagaaggccgggguacagguauggcugggggccaacggcaagguagcaguaaucguuucgaacgaccacgcugguaaguugugcggggcuugugggaauuucgauggggaccaaacuaaugacuggcacgacucacaggaaaagccugcuauggaaaaguggagagcccaagacuuuuccccuugcuauggguag

SEQ ID NO: 26085 - RNA, 4458 nt, Artificial Sequence
  Description of Artificial Sequence: Synthetic coding sequence
auggccgcucccgcccagcccaagaagaucgucgcaccaaccgucucacagaucaacgcagaauucgucacucagcuggccugcaaauauugggccccgcacauaaaaaagaaaucuccauucgauauuaagguaauagaggauauuuacgagaaagagauugucaaaucaagauucgccauuagaaagaucauguuacuggaauucucucaguaucuugagaauuaucuguggaugaacuauagcccggaagugaguaguaaagccuaucucaugucuaucuguugcaugguaaaugagaaauuccgcgaaaauguccccgcuugggaaauauuuaaaaaaaagcccgaccacuucccuuuuuucuucaaacauauucugaaagccgcacucgccgagacagauggugaauuuucacuccacgaacagaccguacuucuccuuuuucuagaccacuguuucaauucucuggaaguugaucugauaagaagccaaguccagcagcuuauuucccuacccauguggaugggccuucagcuggcuagacuggaauuagagcucaagaaaaccccuaaacugcggaaguucuggaaccugaucaagaaaaacgaugaaaaaauggacccagaagcacgcgaacaggccuaucaggagcgaagauucuugucccaacucauacagaaguuuaucagcguccuuaagagcguuccccuuucugaaccagucacaauggacaaagugcacuauugugagcgcuuuauagagcucaugaucgaucuggaagcccugcuaccuacccguagaugguuuaacaccauuuuagaugauagucaucuccucguacacuguuauuuaucuaaccuggugagaagggaggaggauggccaccuauuuagccagcucuuggauaugcucaaauucuauacugguuucgagauuaacgaucaaacggggaaugcucucacugaaaaugagaugacaaccauucacuacgaccgcauuacgucccuucaaagagcagccuucgcucacuucccugaacucuaugauuucgcgcugucaaauguugcugagguggacacaagagagucacuggugaaguuuuucggcccucuguccuccaacacccuccaccaggucgccuccuauuuaugccucuuacccacguuacccaaaaacgaggacacuaccuucgacaaagaguucuugcuggaacugcucgugucgcgccaugaaagaagaauaucccagauccagcagcugaaucagaugccuuuguaccccaccgaaaaaauuaucugggacgaaaauauugugcccacagaauacuauucaggagagggaugccuugcgcuuccuaaacugaaccuacaguuuuugacacuccacgacuaccuuuugagaaauuuuaaccuguuucgccucgaguccaccuacgaaauccggcaagauaucgaagauucagugucccgaaugaaaccauggcaguccgaguacggcggagucgucuucggcggcugggcucguauggcucagcccaucguggcuuucacagucguggagguggcaaaaccuaacauaggcgaaaauuggcccacaaggguccgcgcagacgugacuauaaaccugaacguaagagaccauaucaaggaugagugggagggacugaggaagcaugacguauguuuucugauuacagugagaccaacuaaaccauaugggaccaaauuugaccgcagacgaccguucaucgagcaagucgggcugguuuacgugagagggugugaaauucaaggaauguuggacgacaagggacgagugauugaggauggaccggaaccgcgucccaaucugagaggagaauccagaacauuccgcgucuuucuagacccaaaccaguaccagcaggacaugacuaauacuauacaaaacggcgccgaggacgucuacgaaacauuuaacauuauuaugaggaggaagcccaaagagaacaauuucaaagcggucuuggaaacuauucgaaaccuuaugaacacagacuguguaguaccggacuggcugcacgauauaauucuugguuauggcgauccaucuagcgcgcacuacucuaagaugcccaaucagaucgccaccuuagacuuuaacgauaccuuucuuagcauugaacaccugaaagcauccuucccgggccacaauguuaaagugaccgucgaggacccggccuuacaaauaccuccuuuccgaauuacguuuccuguccgcucugguaaaggcaaaaagcguaaagaugcugauguggaagacgaggauacugaggaggccaaaacauugauuguggaaccccaugugaucccuaaccgcggccccuacccauauaaucaacccaaacgaaacacaauucaauuuacucauacacaaauagaagccauccgagcggguaugcagcccggccuuacuaugguugucgggccaccaggaacagguaaaaccgacguggccguucaaaucaucuccaauauuuaccacaacuucccugaacagcggacauuaauaguaacacauucuaaucaggcccugaaccaacuguuugagaagauuauggcucucgauauugaugaacgacacuugcugcgucuugggcacggcgaagaagagcuggagaccgagaaagacuucuccagauaugguagaguuaauuacguacuggcacgccgcauugaacuacuggaggaagugaaacggcuucagaagucucucggggugccuggcgacgcaaguuauacaugugaaacugcgggcuacuucuuucucuaucaagugaugucaagaugggaagaauacaucucgaagguaaaaaacaaaggauccacccuucccgaugugacagaagucuccacuuuuuuccccuuucaugaauacuucgcuaacgccccacagccaauuuucaaagggagguccuacgaagaagauauggagaucgcggagggcuguuucaggcacauuaaaaaaauuuucacccaacuggaggaauuuagagccucagaacuacugcguucaggucuagauaggucaaaauaucuacuaguaaaggaagcuaagauuauugccaugacaugcacucacgccgcccucaaacggcacgaucuuguaaaauuagguuucaaguacgacaauaucuugauggaggaagccgcucagauucuugaaaucgaaacuuucaucccacuuuuauuacaaaauccccaggauggcuuuucaagguugaaaagauggaucaugauuggcgaccaucaucagcugccgcccguuaucaaaaauauggcauuucagaaguacucuaacauggaacagucacuguucacucgcuucguucgggucggcguacccacgguggaccuagaugcccagggacgggcgcgcgccucacuauguaaccuuuacaacuggagauauaaaaaucuggggaaccugccacauguccagcugcuacccgaguucucuacagccaacgccgggcuccuguaugauuuccagcugauuaauguagaagacuuucagggcguaggagaaucugaaccaaaucccuacuuuuaccagaaccucggggaagcugaauauguggucgcucuguucauguacaugugccuguugggcuauccagcugauaagauuucuauccucacuaccuauaaugggcaaaagcaccugauucgggauauuaucaaucggagauguggaaauaaccccuuaauaggucgccccaacaaagucacuacuguggaccgguuccagggccagcaaaacgauuauauucucuugucccucgugcggacccgggcaguuggacaccucagagacguccgaagguuggucguugcuaugagcagagccagguugggcuuguauauuuuugcccgcguuucacuguuucagaacugcuucgagcuaaccccugccuuuucacaacugaccgcucgaccacuccaucugcacaucauccccacugaacccuucccuacuacccgcaagaacggagagagaccgucucacgaagugcaaaucauaaagaauaugccacaaauggcuaacuuuguauacaacauguacaugcaucugauucagaccacacaccacuaccaccagacucugcuucaguugccuccagcaauggucgaagaaggagaagaaguacagaaucaggagaccgagcucgagacagaggaagaggcgaugaccgugcaggcagacauaauaccuagcccuaccgacacaucaugcagacaggaaacccccgcuuuccagaccgauaccaccccaagugaaacaggagcaacuucuaccccggaagcaauuccagcccucucagaaacaaccccuacagucgugggcgcuguaucagccccugcagaagcaaacacuccccaggacgcaacaucugcccccgaggagacgaaauag

SEQ ID NO: 26086 - RNA, 783 nt, Artificial Sequence
  Description of Artificial Sequence: Synthetic coding sequence
augaagaguaacaucgacaagaaauucucagcacacuacgacgcuguggaggcugaacugaagucaucaacuguaggccugguuacucuuaaugauaugaaagccaaacaggaagcacucgugaaggaacgagagaagcaguuggcgaaaaaagaacagucaaaagagcuucagaugaaacuggaaaaauugagagagaaagaaaggaagaaggaggcaaaacgaaaaaucagcucccugagcuucacccuggaagaagaagaggaaggcggagaagaggaagaagaagcugcaauguacgaggaagagauggagcgagaggagaucaccaccaaaaagagaaaacucggaaagaacccggacguggauacgaguuuucuccccgauagagacagggaggaggaggaaaacagguugagagaggaauuaaggcaagaaugggaggccaaacaggagaagauaaaaagugaggaaaucgaaauaacauucagcuauugggacggcuccggccaccguaggacaguuaagaugagaaagggcaauacaaugcagcaguuccuucaaaaggcuuuggagauucugaggaaggauuuuucugagcucagaagugccggaguugagcaacuuauguacauaaaagaagaccuaauuauaccccaccaccauagcuuuuacgacuuuaucgucacuaaggccagaggaaaaagcggcccacuuuucaacuucgaugugcacgaugacguacgauugcucucugaugcaacugucgagaaggacgaauag

SEQ ID NO: 26087 - RNA, 1725 nt, Artificial Sequence
  Description of Artificial Sequence: Synthetic coding sequence
auggcaucugacuuagaauccucucugacaucuauugauuggcucccacaguuaacuuugagggcgacaauugaaaaacuuggcagcgcuagccaggcaggaccaccaggcucuucucguaaaugcaguccaggaucuccuaccgacccaaacgcuacucucucuaaagacgaggcugccguccaccaggacggcaaacccagguacucguaugcuacccugauuaccuaugccaucaacagcucccccgcuaaaaagaugacacucagugaaauauacagauggauuugcgauaauuuuccuuacuauaaaaacgcuggcaucgguuggaagaacucaaucaggcacaaucucagucucaacaaguguuuccguaagguaccacguccccgcgaugacccugggaaagggaguuacuggaccaucgacacauguccagauauuagcagaaagagaagacacccuccagacgaugaucucucacaggacaguccagaacaggaagccucaaaguccccucgcggcgggguugcuggcucgggggaagcuagccuaccaccagagggcaacccccagaugucacuacagucucccacuucuaucgcaucuuacucucagggaacaggcagcguagacggaggugccguagccgcuggggcuucaggucgcgaauccgcugaagguccaccaccucuguacaauaccaaucaugacuuuaaguuuucauacuccgagauuaacuuccaggaccucucuuggucuuuucgaaaccuguacaagagcauguuggagaaaagcuccuccagcagucaacacggcuuuagcucccucuuaggagacaucccccccaguaacaacuacuacauguaucagcaacagcagccaccucccccucagcagcaacagcagcagcagcaaccaccacagccgcccccccagcagucucaaccacaacaacaacaggcuccagcacaaggccccuccgccgucggaggcgcaccuccucugcauacgcccucaacagacggcuguacgccacccggcggaaaacaggcaggggcugaaggcuacgggccaccaccagugauggcuaugcacccacccccucugcagcaugguggguaccacccgcaccagcaccauccccacucgcaccccgcccaacaaccuccucccccccagccucaggcucaaggacaggcccccauuaauaacaccgguuuugcuuucccaucagacugguguuccaacauagacuccuugaaagaguccuucaaaaugguuaauagacugaauuggucuucaauugagcagucucaauuuucagaacugauggaaucucugagacaggcugagcagaagaacuggacacuagaccaacaucauaucgcuaaccuuugcgauucccugaaucacuucuuaacccaaaccggccacgugcccccucagggaggaacacaccgcccaccugcccccgccagaaucgcugauucaugcgcccugacauccggcaagcaagaauccgcaaugagccagguuaauucuuauggccauccgcaggccccucaucuguacccagggccuucuccaauguacccuaucccgacccaagacuccgcgggcuauaacaggccagcccaucauauggucccucgaccgucuguccccccuccaggagcuaaugaagaaauuccugaugacuuugacugggaucugaucacauag

SEQ ID NO: 26088 - RNA, 1431 nt, Artificial Sequence
  Description of Artificial Sequence: Synthetic coding sequence
auggccgacaguaaagaagguguucuucccuugacugcagcuucaaccgcccccauuuccuuuggcuuuacuagaacgagugcucgaagacgccuggccgacuccggcgauggcgccggaccuucuccugaagaaaaggauuuccugaaaacuguggaaggucgggaacuacagucaguuaagccgcaggaagccccaaaggaauuggugauuccacucauacagaauggccauaggagacaaccccccgcacgccccccugguccuagcacagauacaggcgcccuggcugauggagugguaucacaggccgucaaagaacuuauugcagaauccaagaaaaguuuggaggaaagggagaaugccgguguagauccuacccuagccauaccgaugauacaaaaaggguguacccccagcggggaaggugcagacucugagccccgugcagagacagugccagaagaagcgaauuaugaggccguccccguggaggcauauggccuggccaugcuuaggggaaugggcuggaagccaggugaagggauagguagaacauuuaaucaaguggucaagccaagaguuaacucucuucggcccaaagguuugggucugggagccaaccugaccgaggcccaagcccugacacccaccggaccgucaaggaugccucgcccugacgaagagcaggagaaggauaaagaggaucagccacagggccuaguaccagggggggcuguggugguacuguccgggccucacagaggacuauauggcaaagucgaaggccuugacccagauaaugugagagcuaugguucguuuagcgguggguuccagaguggugacaguuagcgaguauuauuuacggcccguuucccagcaagaguuugauaagaacacacuugauuugcgccagcaaaaugggaccgccucuucaagaaagacccuuuggaaucaggaguuauacauucagcaggacaauagcgaacguaagagaaagcaucucccugacaggcaggacggcccagccgccaaaucagagaaggcugcuccacguucacagcacuggcuucaccgugaccuccgcguuagauucguggauaauauguauaaagguggucaguacuacaacaccaaaaugauuaucgaagacguccuauccccagacacaugcguaugcagaaccgaugaaggaaggguacuugaggggcuucgagaggauaugcuggaaacacuagugcccaaagccgaaggugauagagugaugguugugcucggcccgcagaccggucgagucgggcaccuauugucuagagaucgggcccgcucuagagcgcugguccagcugccacgcgagaaucaggugguugagcugcauuaugaugccauuugucaguacaugggaccuucugacaccgacgaugacuag

SEQ ID NO: 26089 - RNA, 618 nt, Artificial Sequence
  Description of Artificial Sequence: Synthetic coding sequence
auggcagcugcagcuggaggagccgccucacgcagaggggcaggaagaccuugcccuuucucuaucgaacacauccugucaucccugccagaacgcagucuacccgcucgcgcagccuguccaccucaaccagcuggccgccagagccccgcaaaacccgaagaaccaggcgcccccgaagccgccccaugcgccuguuguugcuguugcgggccucgggccgcuccuuguggaccacccgaagccgccgccggauuaggagcucgacuagccuggccacugcgacuggguccagcagugccacuguccuuaggcgcccccgcaggagggucuggagcacugccaggcgcagucggccccggaucccagagacguacaaggagacaucggacgauuuuuagcgaggagcaguuacaagcacuugaagcauuauuugugcagaaccaauaucccgaugucaguacucgcgaacggcuagcagggagaauacgacucagagaggagcggguugaggucugguucaagaauagacgggccaaguggcggcaucaaaaaagggcuucugcuagcgccagauuacuacccggugucaagaagucucccaaaggauccuguuag

SEQ ID NO: 26090 - RNA, 591 nt, Artificial Sequence
  Description of Artificial Sequence: Synthetic coding sequence
auggaaaucaucuccaguaaacuauuuaucuugcucacccucgcuacauccucauuacucaccucgaacaucuucugcgccgaugaacuggugaucuccaaucuacacuccaaagaaaacuacgauaaauauuccgaacccagaggcuaucccaagggcgagcgguccuugaacuuugaagagcugaaagacuggggcccgaaaaacguuaucaaaaugucaacaccagcggucaacaaaaugccucacuccuuugcaaaucugccucuaagguucggcagaaacguacaagaagagcgguccgcuggagcuacagccaaccucccacugcgcucuggaaggaacauggagguuagccucguacgucgcguucccaauuuaccucagagguuuggcagaacuaccaccgccaaauccguuugcaggaugcucagcgauuugugccaaggcagcaugcauucccccugcgcaaaugaccucuucuacaguaugacuugccaacaccaggaaauucagaacccagaucagaagcaaucacggcgccuucucuucaagaaaauugacgaugcugaacucaaacaggagaaguag

SEQ ID NO: 26091 - RNA, 2430 nt, Artificial Sequence
  Description of Artificial Sequence: Synthetic coding sequence
auggccggugcugccgccgccgucgccgcuggcgcagcagcgggagccgccgccgccgcugugagugucgccgcucccgggcgcgccagcgccccuccucccccuccuccaguguauugugugugucgccaaccuuacgacguuaaucguuucaugaucgagugcgacaucuguaaagauugguuccacggaagcugcguuggcguggaggaacaucaugcuguagauaucgaccucuaccauugcccuaauugugcuguucuccacggcucuagccucaugaagaaaagaaggaacuggcauagacacgauuauacagagauugaugacggcuccaagccggugcaggccggcacccggacuuuuauaaaagaauugcguucuagagucuucccaagcgcggacgaaaucauuaucaaaaugcauggcucucagcucacacagagguauuuagaaaaacauggauucgauguucccauaauggugcccaaacuagaugaucuagguuugcgucuuccaucuccuacuuuuuccgugauggauguggagagauacgucggaggggauaagguuaucgacgugaucgaugucgcccggcaagcugauucuaaaaugacucugcacaacuacguuaaauacuucaugaacccaaaccgacccaaaguccugaacgugaucagucuugaguuuagugauacaaaaaugucagaauugguagaagucccagacaucgcaaaaaagcucucuuggguugaaaauuauuggccagaugauucaguguuccccaaaccuuuugugcagaaauacugucugaugggcgugcaggacaguuacacagacuuucauauugacuuuggcggcacuagcguuugguaccacguccuguggggugaaaagaucuucuacuuaauuaagccuacagaugagaaucuagcacgguacgaaucuugguccagcuccgucacccagagcgagguuuuuuucggagauaaagucgauaaguguuauaagugcguugugaaacagggacauacucucuucgucccaacgggguggauucacgcaguucugaccagccaagauuguauggccuuugggggcaacuucuuacauaaccugaacauagggaugcagcuaaggugcuaugaaauggagaaacgccuuaagacaccugacuuguucaaguuuccauuuuucgaggccaucuguugguucgucgcuaagaauuugcuggaaacccugaaggaauuaagagaagacggcuuucagccccagacauauuuagugcaaggcgucaaggcccuacauaccgcgcugaagcuguggaugaagaaggagcucgugucagaacacgcuuucgaaauaccggauaaugucaggccagggcaucugauuaaagagcugaguaaggucauaagagcaaucgaagaagagaauggcaaaccuguuaagucucaggggauuccuaucgucugcccagucagccguuccuccaaugaggccacuucuccuuaccacucccguaggaagaugaggaaacugagagaccauaauguucgaacuccuuccaaccuggauauuuuagaacuacauacuagggaaguuuugaagcgccuagaaaugugcccaugggaagaagacauucuguccagcaagcugaacggcaaguuuaauaaacaucuccaaccauccuccaccgugccagaguggcgggccaaagacaacgaucuucgguuacugcucacaaacggccgcaucauaaaggacgaaaggcagccauucgccgaucagucucuguauacagcggauucagagaaugaagaagauaaacgcagaacgaagaaagccaaaaugaagauugaagagaguagcggcguugaagguguugaacaugaggagucccagaaaccccuaaacggauucuucacaagagugaagucggagcugcgaaguagauccagcggauacuccgauauauccgagucagaagauaguggcccagagugcaccgcccuuaaaagcauauuuacuacggaggaaagcgagagcuccggagacgaaaagaagcaagagauaaccucuaacuucaaagaagagagcaauguuaugagaaacuuuuuacagaagucccagaaaccgucacgcucugaaaucccaaucaagagagaauguccuacaucuaccucuacugaagaagaagccauccaaggaaugcugucaauggccggacugcacuauagcaccugucuccaacgacaaauccaguccacugacugcuccggagagcgcaauucucuacaagaccccaguagcugucaugggucuaaucacgagguaaggcagcucuauagguacgacaaacccguggaaugcgaaacccgaagccacuuaugcuguccugacugguccccaacucccgaacuaaaauag

SEQ ID NO: 26092 - RNA, 3291 nt, Artificial Sequence
  Description of Artificial Sequence: Synthetic coding sequence
auggggagcgaagaccauggcgcccaaaacccgaguugcaaaauaaugaccuuucgaccaacaauggaagaauucaaggauuuuaauaaguauguugcuuauauugagucucagggagcacacagggcuggccuugccaaaaucauccccccuaaagaguggaagccacgccagacuuaugaugauauagaugacguuguuauaccagcuccuauucaacaaguggugaccggccagagcggauuguuuacccaguacaacauucagaaaaaagccaugaccgugggcgaauauaggcgacucgcaaacucagagaaauacugcaccccccgccaucaagacuuugacgaucucgaacgcaaauacuggaaaaaucuaacuuucguaagcccaauuuacggggcagauauuagcggaucucuguaugaugaugacguggcucaguggaacaucggaucccuaaggacuauucuggacaugguugaacgggaaugcggcacgauaaucgaagggguaaacacccccuacuuauauuucgggauguggaagacaacauucgcuuggcauaccgaagacauggaucuauauagcauuaauuaccuccauuuuggcgaacccaagagcugguaugcuauccccccagagcacggaaagagacucgaacgguuagcuauugguuuuuucccuggauccucccaggggugugacgcuuuucuuaggcauaagaugacacugauuucaccuauaauucucaaaaaauacggaauuccauuuucaaggauuacucaggaggcgggggaauucaugaucacauucccauacggguaucacgcuggguuuaaccacggauucaacugugcagagucuaccaauuuugcuacucuccgcuggauugacuacggaaaaguggccacccaaugcacuugccggaaggauauggugaagaucucaauggauguauucgucaggauucugcagcccgaacgcuaugaauuguggaagcaaggcaaagauuuaacaguguuagaucauacacggccuacagcccuaaccuccccggaacuuucuagcuggucugccucuagagcuucacugaaggcaaaacugcuccgccggagucacagaaagaggagucagccaaaaaaacccaagccugaagacccgaaguucccaggggaaggcacggcaggagcagcauuauuggaagaagcagguggcucugugaaggaagaggcugggcccgagguugauccugaggaagaagaggaggagccacagccccugccucaugggcgagaggcugaaggcgcagaggaagacggaagaggaaaacuuagacccaccaaggccaagagcgaaaggaagaaaaaaucauuuggacuccuucccccacaacuaccucccccuccagcucacuucccuagugaagaagcacugugguugccuucgccacuggaaccucccguguuagguccgggaccugcggccauggaggaaagccccuugccagcaccuuuaaauguaguuccacccgaagugccuagcgaagaauuggaagcaaagccaaggccaaucauuccuaugcuguacgucguacccagaccaggcaaagcagcguucaaccaggaacacgugucuugucagcaggccuuugagcacuuugcucagaaggguccaacauggaaagaacccgugucaccaauggaguugacuggaccagaggauggagccgcuuccagcggagccgggcggauggaaaccaaggcucgggcgggugaaggccaggcucccuccacuuucagcaagcugaagauggaaaucaaaaaaucacgcaggcacccccucgguaggccccccacgcggucuccccuguccgucgucaaacaggaggccuccucagacgaagaagccucaccauucuccggcgaggaagauguuuccgauccugaugcauugcgaccacuucugagccuacaguggaagaauagggccgcuucauuucaagcggagcguaaauucaacgcagcugccgccagaaccgaaccauacugugccauuuguacauuguuuuacccuuacugucaagcacugcaaaccgagaaggaagccccaaucgcaucacucggcaaagguugccccgcaacacucccaucgaagagcagacagaagacacgccccuuaauacccgagauguguuuuacgagcgguggggaaaacacugaaccccugccugccaacucguauauaggcgacgacgggaccucuccucugaucgccugcggaaaguguugcuuacaaguacaugcuaguuguuauggcauuagaccugaauuggugaacgaaggguggacauguucucggugugcugcccacgcuuggacugcugaaugcugcuuguguaaccugcgggggggagccuuacagaugacaaccgaccgccgauggauucacguaauuugugcaaucgccgucccugaagcgcgcuuccugaaugucauugaacgccacccggucgacauuagugccauuccugaacaaagguggaaauuaaaguguguuuacugcagaaagcggaugaagaagguuucaggcgccuguauccagugcucuuacgaacacugcuccacauccuuccaugugaccugugcacaugcagcugggguucuuauggagccagacgauuggccauaugucguuucuauuacaugccucaaacauaaaucuggcggccaugccguacaacugcucagagccgucucccugggucaagucgugaucacaaaaaacagaaacggccuuuacuaucggugccgcgugauuggggccgcuucacaaacuugcuacgaagugaacuuugacgaugguagcuauuccgacaaccuguauccggaaaguauaacuagccgggauuguguacaauuagggccacccuccgaaggugaauugguggaacuuagauggaccgacggaaaccuuuacaaagcaaaguuuauaagcuccgucaccucucacauuuaccagguggaauucgaggauggaagccaacuaaccgugaaaagaggagauaucuucacucuggaggaggaacugccgaaaagagugcgguccaggcugagccuuucaacgggcgcaccacaggaaccugcguuuucaggcgaagaagccaaagcagcgaagcgcccccgcguuggaacaccacuggcaaccgaggacagcggucgcucucaggacuacguagccuucguggaaagucuacuccaaguccaaggacgaccaggagcucccuuuuag

SEQ ID NO: 26093 - RNA, 2289 nt, Artificial Sequence
  Description of Artificial Sequence: Synthetic coding sequence
auggaaggcccuagauccucuacucauguaccgcuggugcuccccuugcucguguuacuguuacuggcgcccgccagacaggcugcagcccaacguugcccucaagcaugcaucugcgacaacucacggcgacacguggccuguagauaucagaaucuaacugaagugccggaugcaaucccagaguugacccaaaggcuugaccuccaggguaaccugcucaaagucauccccgcugcugcuuuccaaggcgugccacaccugacucaccuggaccugcgucacugcgaaguagaacucguugcugaaggugcauuucgugguuugggccgucugcuauuauugaaucuggcaucuaaucacuuacgagaacuaccccaggaagcccuggaugggcuugggagucugcgcagacuggagcuggagggcaacgcauuggaggaacugcggccugggacauuuggagcucuuggagcgcucgcaacccuuaaccuugcccacaacgcgcuuguguaccuaccggcaauggcuuuucaaggacuccucaggguacgguggcugcgccuuucucauaacgcucugucuguuuuggcuccugaggcccucgcaggcuugcccgcacugagaagacugucccugcaucacaaugagcuucaggcccugccuggacccguucuaagucaggcccguggacucgcccguuuagagcuugggcacaacccucugacuuacgcuggcgaggaggacggauuggcuuugccuggacugcgcgaacugcuauuggacggcggcgcacugcaggcccucggaccacgugcauuugcccauugcccucgacuccacacucuggaucuacgcggcaaccagcuggacacccuccccccucugcagggaccgggucagcuucgaagacugcggcugcaggggaacccgcuuuggugugguugucaagcucgcccacugcuugagugguuggcccgggcccguguacgcucagauggggcuugccaggggcccaggcgccugcggggagaggcauuggaugcgcuaagacccugggaccugagaugcccgggggacgccgcacaagaggaagaggaacuggaagagagagcgguagccgguccuagagcaccaccuaggggaccaccccgaggacccggggaggagcgggccguggcaccauguccacgcgcgugcgugugcgugcccgaaucgagacacucaucuugugagggaugcgggcuccaggccgucccacggggcuucccaagugauacccaacuacuugaucuccgaaggaaccauuuucccucuguaccccgugccgcauuuccuggauuaggucaucucguuucuuugcaucugcaacauugcgguauagccgagcuggaagccggagcccuagcgggccuuggacggcugaucuaucuguaucugucugacaaucagcuagccggucuguccgcugcugcacuagagggagcuccucgccugggguauuuguaucucgagcgcaaucguuucuugcaggucccuggugcugcacuacgcgcacucccaagccucuucagcuugcaucuccaggauaaugcuguggauagguuggcuccgggugaccucgguagaaccagagcccugcgguggguguaccugagugggaaucguaucacagaaguuucucucggagcccuaggccccgcccgcgaacuggaaaaauuacaccuagaucguaaccagcucagagaaguuccuacaggggcauuggaagggcugccagccuugcuugaacuccagcucucaggaaacccccugcgcgcucucagagauggcgcuuuucagccuguaggcagaagucugcaacaucuuuuccuuaauucaagcggccuugagcaaaucuguccuggagcauuuagugggcucgggcccggacugcagucacuucaucuccaaaagaaucagcuacgagcucugccugcucuuccuagccucucccaacuggagcuuauagauuuaagcuccaaccccuuucauugcgauugccaauuacugccucugcaccgaugguugaccggacuuaaucuccgagugggagccacgugugcaacccccccuaacgcuagagggcaaagagugaaagcugcugcggccguauucgaagacuguccagguugggcagccaggaaagccaaaaggaccccagcaucgagacccagcgccaggcgaacaccuauaaaaggcagacaaugcggcgccgauaaggugggcaaagaaaaaggacggcuguag

SEQ ID NO: 26094 - RNA, 1059 nt, Artificial Sequence
  Description of Artificial Sequence: Synthetic coding sequence
auggccccuaaauugauaacaguacugugccuuggauuuuguuugaaccagaagauauguccacacgcaggcgcccaagacaaguuuucccuaucugcauggccaucccccguuguuccccucggcggcagggucacccucucuugccauagccaccuccguuuuguaaucuggacaauuuuucagaccacgggcacgcggucacacgaguugcauaccgggcugagcaauaauauuacaaucucccccguuacucccgaacacgcagguaccuaucggugcguugguauauacaagcacgccaguaaguggagcgccgaaaguaacucacugaaaauuaucguuacaggccuguucacgaaaccuagcauaucagcacaccccucaucccuagugcacgcgggcgcccgagugucucuucgcugucauuccgaguuggccuucgaugaauuuauucucuauaaggaaggucacauccaacacagccagcaguuggaucaagggauggaggccgggauucauuacgucgaggcaguauuuuccaugggcccagugacuccugcacacgccggcgcauaucguuguugcggcuguuuuucccacagucgcuaugaauggagcgccccuucagacccacucgauauaguaaucacaggaaaguauaagaagccuagucugagcacccaaguggacccaaugaugagacuaggcgagaagcucacauuguuuugcucuucugaaaucaguuuugaccaguaucaccucuuuagacacggagucgcacacgggcaauggcuaagcgggggacaacggcaucgcgaagcuuuucaggcuaauuuuucugugggaagagcuacgcccgucccgggaggaacauaccgcugcuacgguucauuuaacgauucuccuuauaagcccccagugacacggugcaauuuuacuccccaggaaacccugagagugcuucucugucauagccaaaauccgccucucaaccuuacucaccucgcucucaaagacucccccgccacuuguauuugcucucucgacucacaguag

SEQ ID NO: 26095 - RNA, 624 nt, Artificial Sequence
  Description of Artificial Sequence: Synthetic coding sequence
auggcaggaccugccacucagaguccuaugaaacuuauggcucuacagcuucugcuauggcacagcgcgcuguggacagugcaggaggccaccccgcucggacccgccucuucccuaccccaaucuuuuuuacugaaaugccuggaacaggucagaaagauacagggcgauggcgccgcucugcaggaaaaacuagugucugaaugugcgaccuacaaacucugccaucccgaagaauuaguucugcuuggucacagcuugggcauucccugggcaccccucuccuccugucccucacaggcuuuacagcuggccggcugucucagucaacuacacaguggucucuuuuuauaucaggggcuccugcaggcuuuagaggguauuagccccgaacucggcccuacucuagacacucugcagcuggacgucgcagauuucgcaacgacuaucuggcaacagauggaagagcuaggcauggccccggccuugcaaccaacccagggagcaaugcccgcuuuugccagugcguuccaacggagggcaggcgguguuuuaguggccucacauuugcagaguuucuuagaagugagcuaucgcguacuccgucauuuagcccagccauag

SEQ ID NO: 26096 - RNA, 1476 nt, Artificial Sequence
  Description of Artificial Sequence: Synthetic coding sequence
augaagaccuuuaccuggacauuaggcguucucuucuuucuucuuguagauacaggucacugucgggggggacaauucaagauuaaaaagauaaaucagcguagauacccuagagccaccgaugggaaggaagaagcuaagaagugcgcuuauacauuucuggucccugagcagcggauuacaggccccauaugcguaaacacuaagggacaggaugccaguaccauuaaagauaugauaacuagaauggauuuggaaaacuuaaaagacguucucagcagacaaaagcgcgagauagaugugcugcagcuggugguggauguugacggaaacauugugaaugaagugaaauugcugaggaaagaaucccgcaacaugaacucuagggugacccagcuuuauaugcaacucuugcaugaaauuauccggaagcgcgacaauucauuggagcucucccaguuagagaacaaaaucuuaaaugucaccaccgaaauguuaaagauggccacccgguaccgcgagcucgagguuaaauacgcuagcuuaacugaccuaguaaauaaucaaagcgucaugauaaccuugcuggaggaacagugccuccgcauauucagccggcaggauacucauguuuccccuccccuugugcagguugucccgcagcacaucccuaauucacagcaauacaccccgggcuuguuagguggcaaugagauacaacgugaucccggguacccuagagaccucaugccuccucccgaucuggcaacuucgccuacuaagaguccauucaagauccccccugugacuuuuaucaaugaaggacccuucaaagacugccaacaagcuaaagaagcuggucacucagugucugggauauauaugauuaaaccagaaaacagcaacggaccaaugcaacuguggugcgagaauagccuagacccagguggauggaccgugauucagaaacguacugacggcaguguaaauuucuuuaggaacugggaaaacuacaaaaaaggguuuggaaacauagauggggaauauuggcucggcuuagaaaauaucuacauguuaagcaaucaagauaacuacaaguugcucauugaguuggaggauuggucagauaagaagguguaugcugaauacucuagcuucaggcuggagcccgaaagugaauuuuacagacuaaggcucggaacauaucagggcaaugcuggcgacucuaugauguggcacaacgguaagcaauucacgacacucgaucgcgauaaggauauguaugccgggaacugcgcacacuuccauaagggaggguggugguauaacgcaugugcccacucaaauuugaauggugucugguauaggggaggccauuacaggagcaaacaucaagaugguauauuuugggcugaauacagaggggguucauauuccuuaagagccgugcagaugaugaucaaacccauugacuag

SEQ ID NO: 26097 - RNA, 1833 nt, Artificial Sequence
  Description of Artificial Sequence: Synthetic coding sequence
auggacgacgauaaacccuuucaacccaaaaauauauccaagauggcagaacuguucauggaaugugaggaagaagaguuggaaccauggcagaagaagguggaggaaacccaggacgaagaugacgacgagcuaauauuuguaggcgagaucucuaguuccaagccagccauuucuaauauccugaauagggggcauuccagcucauccuccaaagguauaaagucugaaccucauuccccagguauuccagagauuuuccggacugcgucucaacgcugcagggaccccccaagcaacccgguagccgccaguccaagauuccaccugguuuccaagagcucucagagcaguguuaccguagaaaacgcauccaagccagauuuuaccaaaaauucucaaguuggaagugauaacagcaguauacuccuguucgacucuacacaagaaucucuuccaccaagccaggacauucccgcuaucuuucgagaagggaugaagaacacauccuauguccuuaaacaccccucaacgaguaagguuaauucaguaacucccaaaaagcccaagacuuccgaagacgugccucaaaucaacccuuccacaucuuuaccucucauugguucuccaccagugaccaguagccaagucaugcuuaguaagggcacuaacaccuccucaccauaugaugccggcgccgauuauuuaagagcuugcccuaaauguaacguacaauuuaaucucuuagacccucugaaguaucacaugaagcauugcuguccagauaugaucaccaaguucuuaggcgugauuguaaagucagaaaggcccugcgacgaagauaaaaccgauuccgagaccgggaagcucaucaugcugguuaacgaguucuacuaugguaggcacgagggagugacagaaaaggagccuaagacauauacuaccuucaagugcuuuucauguaguaagguucucaaaaacaauauccgcuuuaugaaccauaugaaacaucaccuugaacuggaaaaacagaauaaugaaagcugggagaaucauacgacaugccaacacugcuaucgccaguacccaaccccauuccagcugcagugccacauugaguccacacauacaccccaugaauucucuaccaucuguaagauaugugaauuaucauucgaaacagaacacaucuuguugcagcauaugaaagacacacauaaaccuggggagaugccauacguaugccagaaaaaaggcguccacagaugccccaaauguagguugcaauuccuuacaucaaaagaaaaagccgaacacaaagcccaacaucgcacauuuaucaaacccaaggaacuggagggccuccccccuggugcuaaaguaacuauccgggccagccucgggccccugcaguccaaacucccuaccgcaccuuucggcugcgcccccggaacaucguuccuccagguuacaccccccaccucucagaacaccacagccagaaacccccggaagaguaacgcuagucgcagcaagaccucgaagcuacacgcaaccacuuccaccgccucgaaagucaauacuagcaagccuaggggucggaucgccaagucaaaagccaagccuuccuacaaacagaagcgacaaagaaaucguaaaaacaaaaugucacucgcacuaaagaauaucagaugucgcagagguauccauaaauguauugagugucacuccaaaauuaaggauuuugcuucccauuuuucuaucuauauucacuguucuuuuuguaaauacaacacuaacuguaacaaggcuuuuguaaaccacaugauguag

SEQ ID NO: 26098 - RNA, 1083 nt, Artificial Sequence
  Description of Artificial Sequence: Synthetic coding sequence
augcccgagcuugugguuaccgcguugcuugcgcccagccgccuaucuuuaaaacugcucagggccuuuauguggagcuuaguauucagcgucgcacuggucgcagcugccguuuauggcuguauugcacuuacacacgugcucugccggccuagacgcgguuguuguggucggagacggucugcuucaccagcuugccucucagaucccucccuuggugaacauggauuucuuaaccugaagaguucaggacugcgucuccauuacgugucugcaggucgcggcaauggcccccugaugcucuuucugcaugguuucccugagaauugguucaguuggagguaccaacuacgcgaauuucagucccgguuucacgugguugcaguggauuuaagaggguacgggccaagugaugccccucgggauguggacuguuauacaaucgaucugcucuuaguugauaucaaagaugugauccugggccuagguuauuccaaguguauccugguggcccaugacuggggagcuuuacuggcguggcacuucaguauuuauuacccuucccuugucgagcguauggucguggugucaggcgccccaauguccguuuaucaggauuauagcuuacaucacaucucccaguuuuuuagaagccauuauauguuccuuuuccagcuaccgugguuaccugagaaauuauuguccauguccgacuuccagauccuuaagaccaccuugacccaccgcaaaaccggaauacccugucucacaccuucugagcuugaggccuuucucuauaauuuuagccaacccgggggacugaccggcccgcugaacuacuacaggaaccuauuuagaaacuuuccuuuggagccacaggagcucacaaccccuacucugcuguuguggggagaaaaggacaccuauuuagagcugggccugguggaggcuaucggaagucguuucguuccaggacgacuggaagcacauauucugcccggcauuggucacuggauuccacagaguaauccacaagaaaugcaucaguacaugugggccuucuugcaggaucuguuagauuag

SEQ ID NO: 26099 - RNA, 16218 nt, Artificial Sequence
  Description of Artificial Sequence: Synthetic coding sequence
augggcgcccucuggagcugguggauucugugggcuggagcuacacuccuuuggggcuuaacgcaagaggcuuccgucgaccugaagaacacagggcgcgaggaauuucugacugcauuucugcaaaacuaccagcuggcauacucaaaagcauauccaaggcugcugaucucauccuugucugagucaccugcaagcguaucaauccuuucccaggccgacaauacauccaaaaaaguuacugugagaccaggcgaaucaguaauggucaauaucuccgcaaaagcugaaaugaucggauccaaaauuuuccagcacgccgucgucauucauagcgauuacgcuaucucaguucaggcacugaacgcuaaacccgauaccgccgaguuaacacuacugcgcccuauccaagcguuagguacagaauacuuuguuuuaacaccuccugggaccucagcccguaaugucaaagaauuugcaguggucgcuggagcugcaggagcaagcguuucugugacacucaaggggagcgugacuuucaaugguaaguucuauccagcuggagacguuuuaagagucacccugcagccauacaacgucgcacaauugcaaagcagcgucgaucuuagcggcuccaaagugacugccaguucucccgucgccguucugagcggucauucaugugcacagaaacacacgaccugcaaucacguuguggagcaacuucugcccaccucagccuggggcacacauuauguagugcccaccuuagcaagucagagucgauaugaucuggcauucgucgucgcuagccaggcaacaaaacugacauauaaucaugguggaauuacuggcaguagagguuuacaagcuggggauguaguggaguucgaaguccggccuuccuggccauuguauuuaucugccaacguugguauucaggucuuacuauucgggacaggggcaauccggaaugaagugaccuaugacccuuaucuggugcugauuccugacguggcugccuauugcccagcuuacguuguuaaaagcguaccgggaugugagggcguggcccuggugguagcucagacgaaggccauaagcggacuuacaaucgauggccaugccgucggcgccaaacucaccugggaggcuguaccuggaucugaguucuccuaugcagaaguggagcuggggacggcugacaugauucacacagccgaagcuacaacuaaccucggucugcugacauuuggucuugccaaggcuauaggauacgccacugcagcugauugcggaaggacuguguuguccccuguggagccuucuugcgaagguaugcagugcgcagccggucaacgcugccagguggucggagggaaggcaggaugcgucgcggaaucaacggcuguaugcagagcacagggggauccucauuacacuacauuugacgggagaagauaugauaugaugggcaccugcaguuacacgaugguugaacugugcucugaagacgauacccuuccugcuuucagcguggaagcaaaaaaugaacacagagggaguagaaggguuucuuacguaggcuuggugaccguccgcgcguacucccauucugugucauugacucgcggugaagugggguucguucugguggauaaccagcguaguagacugcccgucucauuguccgaagguagauugcgaguguaccagucgggaccucgagccgucguggaacuaguauuuggccucguggugacuuaugauugggauugccaacuagcccucuccuuaccugcccgcuuccaagaccaggugugugggcucugugggaauuauaacggagauccagcugacgacuuucucacccccgacggcgcccuugcaccugaugccguugaguucgcaucuaguuggaaacuggacgacggagacuaccuuugcgaagacgggugccaaaauaauugcccugccugcacgcccggccaagcucagcauuaugaaggagaucgccugugcggcauguugacuaaauuagacggaccuuucgccguaugucacgauacacucgauccuaggccauuccuggaacaaugcgucuacgaccuguguguugugggcggcgaaagacugucacuguguagaggguuaagcgccuaugcacaagccuguuuagaauuaggaauaagugugggcgacuggagaagccccgcuaacugcccauuaagcugcccugccaacagccgcuacgagcugugugguccugcaugccccacauccuguaacggcgccgcagcuccguccaauuguaguggaaggcccugcguugaagguuguguuugcuuacccggauucguugcuagcggaggugcuugcgugccugcgagcuccugugguuguacauuccaaggacuccagcuggccccuggccaagaggucugggcugaugagcugugucagcgacgcuguaccugcaauggagcuacccaccaagugacguguagagacaaacaguccugcccugcaggagagagaugcucugugcagaacggccuccuggguugcuaucccgaucguuuuggcaccugccaaggcucaggugauccacauuacguguccuuugauggcagaagguucgauuucaugggcaccuguaccuaucugcuuguuggcucauguggacagaaugccgcccucccagcuuuucgaguguuggucgaaaaugagcauagaggcucacaaaccguaagcuauacccgugcugugagaguggaagcuagggguguaaaaguggcaguaagacgggaauaucccggccaggugcuaguggacgaugugcuccaauaucugccuuuucaagcagcugacggccaagugcaaguguucaggcagggacgggacgccguggugagaacagacuucggguuaaccguuacauacgacuggaaugccagggugacagccaaaguccccucuucauaugcggaagcgcuauguggacugugugggaacuucaauggcgaucccgccgaugaccuugcccuaagaggaggaggccaggcagcaaaugcacuugcauuuggcaacuccuggcaggaggagacuagacccggauguggagcgacagagcccggugauugucccaaacucgacucacugguggcccagcaauuacaaaguaagaacgaauguggaauucuagcugauccuaaggguccauuuagggaaugucauaguaaauuagacccccagggggccgugcgagacuguguguaugacaggugccugcuaccuggucaguccggcccccugugugacgcgcuugcuacauaugccgccgcgugccaggcagcuggcgccaccguucacccauggagaagcgaagaauuguguccccuguccuguccgccgcauagccauuaugaagcauguucauacgggugccccuugaguugcggcgaucugcccgucccaggcgguugugggucagaaugucaugaaggaugcgucugugacgaaggauuugcacuaagcggcgagucuuguuuaccccuggcuucaugcggcugugugcaucaaggaaccuaucacccuccuggacagaccuucuaccccgguccuggaugugacucguugugccauugucaagaaggaggacuagugucaugcgagucuuccuccugugguccccacgaagcaugccaaccauccggcggcaguuugggcuguguugcugucggaagcucuacaugccaagccuccggcgauccacacuauaccaccuucgaugggaggagauucgauuucaugggaaccuguguguacguuuuagcgcaaacaugcgguacgagaccaggacuucacagauuugcuguucuucaggagaauguggccuggggaaauggccgggugucggugacaagggugaucacggugcaaguggcaaauuuuacccuccgacuagagcagcggcaauggaaggugacagugaauggcguugacaugaagcucccuguggugcuggcgaacggacagauccgcgccucucagcacgggucugacguugugauagaaacugauuuuggguugagaguggcauaugacuugguauacuauguaaggguuacagucccuggaaauuacuaucagcagaugugcggccuauguggcaauuauaacggagauccgaaggacgacuuccagaagcccaacgggucccaggcuggcaacgcuaaugaauuuggaaauucuugggaggaaguagucccggauucgccaugccuucccccaacuccuugucccccagguucugaggauugcaucccuagccauaaauguccucccgagcuugagaagaaguaccagaaagaagaauucugcggccuccuaucuagcccaacuggaccccuaucgucgugccacaagcuggucgauccacaaggaccccugaaagacugcauauuugaccugugccuggguggcggcaaccugucaauucuguguaguaauauccaugcauacgugucagcaugucaggcugcuggugggcauguagaaccuuggcgcaccgaaacguucuguccaauggaaugucccccaaauucacauuacgaacucugcgccgacacauguagccuggguuguuccgcccugagugcuccuccccaaugccaggacgggugugcagaggggugucagugugacucuggcuuccuuuauaacgggcaggccuguguaccaauucagcagugcgguugcuaucauaacggcguauacuacgaaccugagcaaaccguguuaaucgacaauugccgucaacaguguacuugucacgcagggaaaggcauggugugccaggagcacucuugcaaacccggccaagucugucagcccucgggaggcauucucucuugcguuacuaaggauccuugccaugggguaacauguagaccucaggagacuugcaaagagcaggguggccaaggugugugcuuaccuaauuaugaagcaacuuguuggcucuggggggacccccacuaucauuccuuugacggacguaaauucgauuuucaggggacuugcaacuacguauuagccacgacuggaugcccaggagucucgacucaggguuugacaccauuuacugucaccacgaagaaucaaaacagaggcaaccccgcuguuaguuacguuagagucgugacuguggcugcccuuggcacuaacaucaguauccauaaggaugagaucgggaagguaagaguuaauggagugcugacugcccuuccuguauccguggcagacggacgaauaagcgugacccagggugcuaguaaggcauuacuggucgccgauuucggacugcagguaucuuaugauuggaacuggaggguggacguuacacuuccaagcagcuaucacggggccgucugcgggcuaugcgguaauauggaccguaacccgaauaaugaucaggucuucccaaauggcacauuggccccauccauuccgauauggggggguagcuggagagccccagguugggaucccuuguguugggaugaaugcagaggcuccugcccuacuugcccugaggaccggcuagaacaguacgaaggcccaggauuuugcggaccccuagcaccuggcacugguggaccuuucacuacgugucacgcccacgugcccccagagucuuucuucaaaggauguguccuggacguuuguaugggcgguggagaucgcgauauacuguguaaagcucuagcauccuacgucgccgccugccaagccgcugguguagugaucgaggacuggcgggcccagguggguugugaaaucacuugccccgaaaauagccauuaugaagugugcggaagccccuguccugcaaguuguccaucccccgcaccuuuaacaacuccugcaguaugcgagggacccugcguggaagggugucagugcgaugcaggcuuuguccugagcgcugaccgaugcgucccccugaacaauggaugcggauguugggcuaacggaacauaccaugaggcuggauccgaguucugggcagauggcacaugcucccaguggugccggugcggccccgggggcggcucauugguuugcacucccgcgucgugcggucucggagaaguguguggccuacuuccuagcggccaacaugggugucagccugucaguaccgcagagugucaggccuggggcgauccucauuacguaacacuugaugggcaucgguucaauuuccaggguacaugugaauaccuucuuagcgccccuugccacggcccgccacugggagcugagaacuuuacaguaacuguggccaacgagcacagaggaucucaagccgugucuuauacucgguccguuacacugcagaucuacaaccauucucugacacugucugcccgcuggccaagaaaacuccagguggacggaguuuucgugacacugcccuuccaacuugacucacuucuucaugcccaucucucaggcgccgacgucgugguuacaacaacaucuggacuuagucuggcauucgacggcgacagcuucgucagacugcgggugccugccgccuaugccggcagccucugcggccugugcgggaauuacaaucaggacccagcagaugauuuaaaagccguuggagggaagccagcaggauggcaggucgggggcgcucaggggugcggcgaguguguuucaaagcccuguccgucaccuuguacaccggaacaacaagaaucauuuggcggaccggacgcaugcgguguuauuagugccacugauggaccauuggcaccgugccauggcuugguaccacccgcucaauauuuccagggaugccucuuggaugccugccagguacagggacauccaggcggccugugcccugccguugcuacuuacgucgccgccugucaggcugccggagcacagcugcgcgaguggcgaagaccugacuuuugcccuuuucaguguccagcucauucccauuacgaauuaugcggugauuccuguccaggcagcugccccucccuuagcgcacccgagggaugugaguccgccugccgagaaggcugugugugugaugcaggauuuguucugucuggugauaccugugugccggugggccagugcggcugccuucacgaugacagauauuauccucucggccaaacuuuuuaccccggcccaggaugcgauucccuauguagaugcagagagggaggcgaaguguccugugaaccuaguucuuguggcccucacgaaacaugcagacccucuggaggaucacuggguugugucgcgguaggaucaacgacgugucaagcuucgggagacccccacuacaccacuuucgacggaaggagguucgauuuuaugggcacuugugucuauguucucgcucagacuugcggcacuaggcccggccugcacagauucgcuguacuucaagaaaacguggccuggggcaacggucgggucucaguuacaagggucauaacuguccaaguugcaaacuucacauugcgccuagaacaacgacaguggaaggugacagucaacggaguggauaugaaguuaccugucguccuggcuaacgggcagauucgggccucacagcaugggucagauguuguuaucgaaacggauuucggccuccggguugccuaugaccugguuuacuaugugagggugacuguccccggaaauuacuaccaacugaugugcggacuaugcgggaacuauaacggugauccaaaagaugacuuccagaagcccaacggaucucaggccggaaaugcuaaugaguucggaaacucuugggaggaagucgugccugacagcccaugccuuccucccccaacuuguccuccaggaucugaaggcuguauuccuagcgaagagugcccccccgagcuggagaaaaaauaccagaaagaagaauucugcggccucuuaucuucgccuaccgggccccuuagcucuugccauaaauuaguagauccacaaggaccccucaaagacugcaucuuugacuuauguuuaggagguggcaacuuaagcauucucugcaguaauauucaugccuauguaucugcaugccaagcugccggaggccagguagagcccuggagaaacgaaaccuuuugcccaauggagugcccucaaaacagccacuaugagcugugcgcugauaccugcucccucgguuguucugcacugagcgccccacugcagugcccagacggaugcgccgagggcugccaaugcgacagcggcuuuuuauacaauggccaagcgugugucccgauccagcagugcggauguuaccacaauggagccuacuaugagccagaacagacugugcugauugacaacuguagacagcaauguacaugccacguuggaaagguggucguuugucaagaacacuccuguaagccaggccaagucugucaacccaguggcggaauacucaguugugugaacaaagauccaugucacggaguaacuugucgcccacaggagaccugcaaagaacaaggcggccaaggggugugucugccuaauuacgaggccacauguugguuguggggagacccccauuaucacagcuucgacggucggaaauucgauuuucaggggaccugcaauuacgugcuggccacuacugggugucccggaguuuccacgcaaggacugacaccuuuuaccgucacgacgaagaaucagaaccgcggcaacccagccguuuccuacgugcgcgugguuacaguugcggcacugggcaccaauauuucuauacacaaggacgagauaggcaaaguaagaguuaauggugugcugacggcauugccaguuuccgucgcugauggcagaaucucugucacacagggggcgagcaaggcacuucucguagcagauuucgggcuccaggugucguacgacuggaauuggagaguggauguuacucuccccagcuccuaccacggcgccguuuguggccucuguggaaacauggaucggaauccgaauaacgaucaagucuuuccuaacgggacuuuggcuccuucuauuccuaucugggguggcaguuggagggcgcccggcugggauccccuuuguugggacgaaugcagaggaagcugcccaaccuguccagaagaccgccucgagcaguacgagggcccaggcuucugcggaccucuggcccccggcacaggaggcccuuuuacaaccugucaugcccacguaccucccgaaucauuuuucaaaggauguguguuggaugugugcauggggggaggcgaucgcgauauccucugcaaagcacuagcgucuuaugucgcggccugccaggccgcaggugucguaauagaagacuggcgcgcccaaguuggcugcgagaucaccugcccagaaaauagccauuaugaggucuguggacccccuugcccagccuccuguccaagccccgccccacuuacaacaccagccgugugugaagguccaugcguggaagggugccagugugaugcuggcuucguucugucugccgauaggugcgugccccuaaauaauggaugcgguugcugggcgaaugggacuuaccacgaggccgggucagaauucugggccgacggaacuuguucacaguggugucgguguggacccgguggaggaucacuugucuguacaccagcuuccugugggcugggagagguaugcggacuucugccuucaggccaacacgguugucaaccgguuaguacggccgagugccaagcuuggggagacccacauuacgugacacuggacggccauagguucgauuuucagggcacaugcgaauaucuccuuucugcacccugccauggcccgccccuaggagccgaaaacuuuacggugacagucgcaaaugaacacagagguucgcaagccgucuccuauaccagaucagucacccuccaaauuuauaaccacagccucacgcuguccgcuagauggccccgcaaacuccagguagacggaguuuucgugacauuacccuuucagcuggauucuuuacugcaugcucaccuuucuggagcagacguagucgugacaaccaccuccggccugucucuugcguuugauggagauuccuucgugcgucuccguguccccgcggcauaugccggcucucuguguggacugugcggaaacuacaaucaggacccugcggacgaucucaaggcagugggagggaagccugcuggauggcagguggguggagcccaaggcuguggagagugcgugaguaagccuuguccaucaccauguacuccggaacagcaagaaagcuuugguggacccgacgcaugcggcgucauuucagccacugauggcccauuagcaccuugucauggguuagucccuccagcccaguauuuucagggcugucucuuggaugcgugucaggugcagggucaucccggaggccuguguccggcugucgccacauacguggccgccugucaagccgcuggcgcucaauuacgugaauggagaaggcccgacuuuuguccuuuccagugcccugcacacucucacuacgaacugugcggugauaguugcccuggauccugccccagucuauccgcuccugagggcugcgaaucugcuugucgagagggaugcguuugcgaugcugguuuuguucucucaggugacaccuguguccccgucggacaaugugggugcuugcacgacgacagauacuacccgcugggccagacuuuuuacccaggacccggaugugauagccucugcagauguagggagggaggagaagucucuugugaaccuucuucaugcggaccucaugagacgugucgcccaucuggagggagcuuaggauguguggcgguuggcagcacuacgugucaggccucaggcgacccacauuacacuacuuucgauggacauagauucgacuuuaugggaaccugcguguaugugcuagcacagacuugcggcacucgcccuggccuccauagauuugcagugcuccaggaaaacguggcaugggguaacggucgggugucaguaacccgggucauaacagugcaaguggcgaauuuuacuuugcgucuugagcagcgccaguggaaagugacaguuaacgguguggacaugaaacugcccgugguacuggcgaauggacaaauacgagcaagccaacauggaucugacguggugaucgagacugauuuuggacuccgaguagccuacgaccugguuuauuauguccgcgugacuguaccuggcaacuauuaucagcugauguguggcuugugugguaauuauaauggggaucccaaagaugacuuccaaaaacccaauggcucucaggcuggcaaugcgaaugaguuuggcaauucaugggaagaaguugugccugacagccccugccugccucccccaacuugccccccuggguccgcgggaugcauuccaagcgacaaaugcccaccugaacuugaaaagaaauaucagaaggaggaauucuguggccucuugaguucuccaaccggcccuuugaguagcugccacaaacuggucgacccccaagguccacugaaagauugcaucuucgaucugugcuuaggcgguggcaaccugucuauucuguguuccaauauucacgccuaugugagcgcuugccaagcugcuggcggacauguggagccuuggagaaacgagacuuuuuguccuauggaguguccucagaacucucauuacgaacugugugcagacaccuguucucuuggaugcuccgcacuaucagccccccuucagugcccagaugggugcgccgaagggugucagugcgauucuggguuccuuuauaacggacaagcaugcgugccuauucaacaauguggauguuaucauaauggaguguacuaugaacccgagcagaccguccucaucgacaacugucggcaacaguguacaugucacguggguaaagucgucgucugucaagagcacagcuguaaacccggccaagugugccagccuucagggggcauucuguccugugucacaaaggacccaugccauggcgugacuugccguccucaggagaccuguaaagaacaaggcggccaaggaguuugucuuccuaacuacgaagcaacauguuggcuauggggagauccucauuaucacucuuucgacggccgaaaauucgauuuucaaggaaccuguaacuauguacucgccacaacaggcuguccuggcguuucaacccagggauugacccccuucacugucacgacuaaaaaucagaaccgggguaaccccgcagugucauacguccggguugucaccguggcagcucucggaaccaacaucagcauccacaaagacgagauugggaaaguccgggugaauggcguucugacggcuuuaccggugagcgucgccgacggaaggauuuccguagcucagggagcuucuaaagcauuguuggucgcagauuucggacugcaagucucauacgauuggaauuggaggguugacgugacacucccuucaucauaccacggggccguauguggacugugcgguaauauggacagaaaucccaauaacgaccaaguguuccccaauggaacuuuagcgcccaguauaccgaucuggggcggcuccuggagggccccuggaugggauccgcucuguugggacgagugcagaggcuccuguccaacaugcccagaggauaggcuggaacaguaugaggggccugguuuuugcggacccuuaaguagcgguaccggaggacccuucacaacaugccaugcccaugucccgcccgaaagcuucuucaagggauguguguuagauguuuguaugggcggaggagaucgagauauccuguguaaagcauuggccagcuaugucgcugccugucaggcugccgguguugugauugaagacuggcgagcucaagucggcugugaaauuacgugcccagagaacagucauuaugaagugugcggcccgcccugucccgcuucaugccccagucccgccccccugaccacuccugcuguaugcgaggggccauguguggaagggugucaaugugacgcugguuuugugcuuagcgccgacaggugcguucccuuaaacaacggaugcgguugcugggccaacggcaccuaccaugaagccgggagcgaauucugggcagacgggacuuguagccaguggugccgcugcgggccaggaggagggagccugguuuguacccccgccaguugcggccugggagagguuugcggacuguuacccaguggucagcacggcugucagccagucucaacagccgaaugucaggcauggggugacccucacuauguuacccuugacgggcaccguuuugacuuucaaggaacuugugaguaccuccuauccgcaccaugccaugggccgccccugggagccgaaaauuucacuguaacuguggcuaacgaacauaggggcucgcaagccguaagcuacacucgauccguaacccuccaaaucuauaaccauagccugacccugagcgcuagauggccacguaaauuacagguggacggcguuuucguggcgcugccuuuucaacuggauucucuguuacaugcccaccucagcggcgccgauguuguggugacuacuacuagugggcucagccuagccuucgacggggacaguuucguucgccucaggguacccgccgcuuacgcugcgucucuguguggccuaugcgguaacuauaaucaggauccggcugacgaucugaaggcuguaggaggcaagcccgcaggauggcaggucggaggcgcacaggguugcggagaaugugugucaaagccuuguccauccccauguacaccagagcaacaagagucauuugggggaccagacgcauguggagugauuucagccaccgacgguccacuagccccuugucacggucuggucccuccagcacaauacuuccagggcugucuauuagacgccugucagguucagggucaccccgguggacucugucccgcuguugccacuuauguagccgcuugccaagccgcaggagcgcagcuaggggaguggaggagacccgauuuuugcccccuucagugcccggcgcauucacacuacgagcuguguggagacucuugucccgugucuugcccuucucugucugcaccggaaggcugugagucugcuugucgggagggcugugucugcgaugcuggauuugugcuaagcggggauacuugcguaccuguuggucaguguggaugccuccacgacggucgcuauuacccccuaggagaaguguuuuaccccggacccgagugugagcggcggugcgaaugcggcccaggaggccacgugacaugccaggaaggcgcugcaugcggcccacacgaagaaugcaggcucgaggacggcgugcaagccugccacgcaaccggcugcggucguugcuuggcaaauggaggcauucacuauaucacuuuggacggucgagucuaugacuugcaugggucauguagcuauguauuagcccagguaugucaucccaaaccaggcgacgaagauuucucuauuguguuggagaaaaacgccgcaggggaucuccagcggcuccugguuaccgucgcaggccaggucguuucacuagcucagggucaacaaguaaccguggauggagaagcugucgcgcuuccuguggcuguggguaggguucggguaacugcugagggcaggaacaugguucugcagacaaccaaaggccuacgucuucuguucgacggugacgcccaucuucuuaugaguaucccaucgccauuccgagggcgccucuguggucucugugggaauuuuaacggcaauugguccgacgauuuuguccugccuaauggcucugcugccaguucaguugagacauucggggcugccuggagagcccccggaagcaguaaaggaugcggugaggguugcggcccucagggguguccugucugucucgcagaggagaccgcaccauaugaaagcaaugaggcauguggacagcucagaaauccccaaggcccauuugcaaccugucaggcuguccugucgcccagugaguacuuccggcaaugugucuacgaccuaugcgcccaaaagggggauaaggccuuccucugucgcagccuugcggcuuauacagcugcuugucaggcagcgggaguggccguuaaaccauggagaacugauucguuuuguccacugcauugcccagcucacucacacuauuccauuuguacuagaacuugccagggaucuugcgccgcucucuccgggcuuacuggaugcacgacacggugcuucgaagggugcgagugugacgaucgcuuccuccugucucaaggugugugcauuccugugcaggauugcgguuguacccacaauggaagauaccugccagugaauucaagucugcucacaagcgacugcucugaaaggugcucauguucuucgucaucuggauugacaugccaggcagccgguuguccaccugggcgggucugcgaagugaaagccgaagcuaggaacuguugggcaacaaggggucuguguguccuuuccgugggcgcuaacuugacaacuuuugauggcgccagaggcgcaaccaccagccccggggucuaugaacuuuccucacgcugucccgggcugcagaauacgaucccaugguacagagugguagcagagguccagaucugucacgguaagacggaagcggucggacaagugcacaucuucuuucaggacggcaugguaacccucacccccaauaaaggagucuggguaaauggcuuacgagucgauuugccugccgaaaaacuggcaagcgugagugucucuaggacucccgacggcucucuuuuggugcggcagaaagccggugugcaaguuugguuaggcgcuaaugggaaaguggcugucaucguguccaacgaucacgcaggaaaauuauguggggcuugugggaauuuugacggagaccagacgaaugauuggcacgauagccaagagaaaccagcuauggagaaguggcgcgcucaagauuucucuccuugcuaugguuag

SEQ ID NO: 26100 - DNA, 2367 bp, Artificial Sequence
  Description of Artificial Sequence: Synthetic coding sequence
atggcagccactactgccaatcctgaaatgacttctgatgtcccctctctcggacctgccatcgcttctggaaattccggacccggaatccagggaggaggagcaatcgtccagcgagcaatcaaaaggcgccctgggctggactttgatgatgatggagaggggaattcaaaatttctgcgatgtgatgatgatcagatgtccaatgataaagaacggtttgctagatctgatgacgagcagagttccgccgataaggaacggctagccagggaaaaccatagtgaaatcgaacggagaagacgaaacaagatgactgcctatataacagaactatcagacatggtacccacatgtagtgcactcgcacggaaacctgataaacttacaattttgagaatggctgttagtcatatgaaatccttaagagggactgggaatacatcaactgatggaagttataaaccaagttttctcacagatcaggagctcaaacatctcatccttgaagcggcagatggattcctttttatcgtgtcttgcgaaacagggcgcgtggtctatgtttctgattctgtaacaccagtactcaatcagccccagtccgaatggttcggatccactttatatgatcaggtgcaccccgatgacgtggacaaattacgagaacagctttccacaagtgagaatgccctcacagggcgaattctcgaccttaaaacaggaacagtgaaaaaagaaggacagcagtcttctatgaggatgtgcatgggaagtaggagatcctttatctgtcgaatgaggtgcggatcttcttctgttgatcctgtctcagtgaatcggctctctttcgtcaggaaccgttgtcggaacggactaggatctgtaaaagatggggaacctcacttcgtggtggtgcattgtacagggtacataaaggcatggccacctgccggagtgagtttgcctgatgatgatcctgaagccggacaggggtctaaattttgtctggtggccatcgggagacttcaggtaacatcatcaccaaattgtacagatatgtcgaacgtttgtcaacccactgaattcatcagtaggcataacattgaagggatttttactttcgtcgatcatcgatgtgtcgcaacagtcggatatcagccacaggaactccttggaaaaaacatcgttgagttctgccatcctgaagatcagcagttgctacgggattctttccagcaggtagtgaaactgaaaggacaggttctgtctgtaatgttcaggttccggtccaaaaatcaagaatggctatggatgaggacatcatccttcacttttcagaacccctactcagatgaaattgaatacataatatgcactaatacaaatgtcaagaatagttctcaggaaccaagacctactctctctaatacaatacagagacctcagctaggaccaactgcaaaccttccactggaaatgggatctgggcagttggctcctcgacagcagcagcagcagacagagctcgatatggtgcccggacgcgatgggctcgcgtcttacaatcactcgcaggttgtgcagcctgtgacaacaacaggaccagaacactctaaacccctcgaaaaatccgacggactctttgcacaggatagggatcctcggttttccgaaatctatcacaacattaacgctgatcagtctaaaggaatctcctcgtccacagtccccgctacacagcagctcttttcccaggggaacacattccctcccacacctaggcctgcagaaaattttagaaattccgggctggcccctcccgtcacaatcgttcagcccagtgcttcggccggacagatgcttgctcagatatctcgccactccaaccccactcaaggagccactccaacttggactccaacaactcgatctgggttctccgcacagcaagttgcaactcaggccactgccaaaacaagaacttctcaattcggagttggatcctttcaaactccatcatctttttcttcgatgtctctccccggagctccaacagctagtccaggggcagctgcttacccctctttaacaaaccgcgggtcaaacttcgctccagagactggacagacggcagggcagttccagacaagaactgccgaaggagtgggggtctggccccagtggcaggggcagcagccacatcatagatccagttcttctgaacagcatgtgcaacagccacctgcgcagcagcccgggcagcctgaagtgtttcaggaaatgttatcaatgctcggggatcagagtaacagttacaataacgaagaattccccgatcttacaatgttcccacctttctctgag

SEQ ID NO: 26101 - DNA, 2367 bp, Artificial Sequence
  Description of Artificial Sequence: Synthetic coding sequence
atggcagctacaactgccaatcccgaaatgacttccgatgtgccttcgctcggacccgccatcgcatctggaaactcaggaccagggatacaggggggaggagcgatagtgcagagagcgataaaacgaaggccaggacttgattttgatgatgacggagagggaaactctaaattcctgcggtgcgatgacgatcagatgtccaacgataaagagcgattcgcacgctcagatgatgaacagtcatcagcggataaagaaagactcgcccgggaaaatcacagtgagatagagagacgaaggcggaacaagatgacagcctatatcacagaactctcagatatggtacctacatgttcggcccttgcccgaaaacccgataaacttacgatacttcggatggctgtctctcatatgaaatccctaagaggaacaggaaatactagtactgacggatcctacaagccctcatttttaactgatcaggaactgaaacatcttatccttgaggcagccgacgggttcctctttatcgtcagttgcgaaactgggagagtggtctacgtaagtgattctgtgactcctgtactgaatcagccccaatccgaatggttcgggtccacgttatatgatcaggtacatccagatgatgtagataaacttagagaacagctgtcaacatctgaaaatgcactgactgggcgcatcttggatctcaaaactgggacggtgaaaaaagaagggcagcagtctagtatgagaatgtgcatggggtctagaagatcttttatctgtcggatgagatgtggatcctcttcagtggacccagtatccgtcaacaggctatcatttgtccgaaatcggtgtaggaatgggttagggtccgtgaaagatggagaaccccacttcgttgtggtgcactgtactggatatattaaggcctggcctcccgccggggtatctctgcctgatgatgaccctgaagctgggcaggggagtaagttttgtctagtggcaatcggacggctgcaagtgacatcatctcctaattgtacagatatgtccaacgtttgccagcctacagaatttatttctaggcataacatcgaagggatctttacattcgttgatcatcgctgtgtggctacagtggggtaccagcctcaggagctcctgggaaagaacatcgtggaattttgtcaccccgaagatcagcagcttctacgtgatagttttcagcaagtggtcaagctaaaagggcaagtactctccgtcatgtttaggtttcgctctaagaatcaggaatggttgtggatgcggacttcgtcctttacatttcagaatccttattcggatgagatcgaatacataatctgtactaacacaaatgttaaaaatagttcccaggaacctagacctactttgtctaatacaatacaaaggcctcagcttggacccacagccaacctgcccctggaaatggggtccggacagcttgccccccgacagcagcagcagcagacagaactggatatggtgcctgggcgcgatggattagcgtcatacaatcactcacaggtcgtacagcccgtgactactacaggacctgaacactctaaacccctagaaaaatcagatggactgttcgcccaagatagggacccccgcttttcagagatttaccacaacataaacgcagatcaatctaaaggaatctcgtcatctactgtccccgctacacagcagctcttttctcaaggaaatacattcccccctactccaaggcccgctgaaaattttcgcaattcaggacttgctccccctgtgactatagttcagccaagtgcttccgctgggcagatgctcgcgcagatctccaggcacagtaatcccactcagggggctacaccaacttggactcctactactcggtctgggttctctgcccagcaggtggccacacaggctactgccaaaacacggacttctcagttcggggtcggatcctttcagactcccagttctttctcctcaatgtcccttcccggggcccccacagcatctcccggagctgcagcatatccatccctcacaaaccggggaagtaacttcgcccccgaaactgggcaaacagctggacagtttcagacaagaactgctgagggggtcggggtctggccacagtggcagggacaacagccccatcacagatcttcttcaagtgaacaacatgtgcagcagcctcctgcccagcagccagggcagcctgaagtgtttcaggaaatgttatcaatgttgggggatcaatctaattcatacaacaacgaagagtttccagatcttactatgttccctcctttctcagaa

SEQ ID NO: 26102 - DNA, 2367 bp, Artificial Sequence
  Description of Artificial Sequence: Synthetic coding sequence
atggctgcaacgactgccaacccagagatgacctccgatgtgccctctctgggccccgcaattgctagcggtaacagtggcccgggcatccagggagggggcgctatcgttcagagggccataaagcgcaggccgggactggacttcgatgatgacggggaggggaatagcaaattcttgaggtgtgacgacgatcagatgtcaaatgacaaagaaagatttgcaaggtcagatgatgagcaatcatccgccgataaggagagactggcaagggagaatcacagtgagatcgagagaaggaggcggaataagatgacagcatacatcacagagttgtccgatatggtccctacctgcagcgcgctcgctaggaaaccagataagctcactatcttgcgcatggcagtctcccacatgaagtctctgcggggcacaggaaatacatcaactgatggttcttacaaaccgagttttctcaccgatcaggaactgaagcatttgatactggaggccgcagacggtttcctgtttatcgtgagctgcgagactggccgcgtggtgtacgttagcgactctgtgactccagtcctgaaccagcctcagtctgagtggttcgggagcactctctacgaccaggtgcatcctgacgatgtcgacaagctgagggagcagctgagcacgagcgaaaacgccctgacagggaggatcctggatcttaaaactgggacagtgaagaaagaggggcagcagtctagtatgcggatgtgtatgggctctagaagatcttttatatgccgcatgaggtgtggctcaagtagtgtggatccagtatccgtgaaccgactctcattcgtgcggaaccggtgtagaaatggactgggctccgtgaaggacggtgagcctcacttcgtcgtggtccactgtactggctacataaaggcttggccccccgcgggcgtgtctctccccgacgatgaccccgaagctgggcaaggaagcaagttttgtctggtggctattggcaggcttcaggtgaccagctcaccaaactgtacagacatgtctaacgtctgtcaaccgactgaatttatctccaggcataatatagaagggatctttacctttgttgaccacaggtgcgtggccaccgtcggctatcagccacaggaactgctcggcaaaaatatcgtcgaattttgtcaccccgaggaccagcagctcctgagggactcattccagcaagtcgttaaattgaaaggccaggtgctgtccgtaatgtttcgatttcgatccaaaaaccaggagtggctgtggatgcgcacttctagtttcactttccagaacccatactctgatgagattgaatatatcatctgtaccaacacaaatgtgaagaacagttctcaggagcctcgccccacacttagcaatacaatccaaagacctcagctcggacctaccgcgaaccttccacttgagatggggtctggccagcttgccccccgccagcagcaacaacagacggagctggacatggtgcctggtagagacggtttggccagttataatcacagccaagtggtgcagccagtaacaaccacgggtcccgagcattccaaaccgcttgagaagtccgatggcctgttcgctcaggacagagatccgcgcttcagtgagatctaccacaatataaatgcggaccaatccaaggggatttcatccagcactgttcctgccacacaacagctgttcagccagggaaatacctttccacccacacctcgaccagccgaaaacttcagaaattccgggctggcgccaccagtgaccattgtccagccaagtgccagtgctgggcagatgctggcacaaatctctagacactctaatcctacccaaggcgcaactcctacttggacccccacaacccggtccgggttcagtgcccagcaggtggcgacacaagccaccgcaaaaactcgcacctctcagtttggagtggggtccttccagactccatcaagcttctccagcatgtccctgcccggcgcacccactgccagtcccggcgcggctgcctacccttcattgacaaacaggggcagcaactttgccccggagaccggccagactgcgggccaattccagacaaggacggccgagggcgtcggggtatggccccagtggcaagggcagcagcctcatcatcgctcatcctcatcagagcagcacgttcagcagccaccagcccagcagccaggccagccagaggtcttccaggaaatgctttccatgctcggcgaccagtcaaatagctacaacaatgaagagtttcccgatctgacaatgttccccccattctccgag

SEQ ID NO: 26103 - DNA, 2367 bp, Artificial Sequence
  Description of Artificial Sequence: Synthetic coding sequence
atggcagctactacggcaaaccctgaaatgacctctgatgtgcccagtctcggaccagcaattgccagcggtaactctgggccgggaattcagggcggaggagcaatcgtacagagagctatcaaaagaagaccagggctcgactttgacgacgacggcgaggggaacagcaaattcctcagatgtgatgacgaccagatgagcaacgacaaagaaagattcgccaggagtgatgatgagcaatctagtgctgacaaagagaggttagctagggagaaccactctgaaatcgaacggaggcggaggaacaaaatgactgcatacatcacagagctgtctgacatggtccccacttgctctgcactcgcaaggaagccagacaagctgaccatcctgcggatggcagttagtcacatgaagtctttaagggggaccggaaatacaagcacagatggctcctacaagcctagttttctcacagatcaagaactcaagcaccttatattggaagcagccgatggttttctcttcattgtcagttgcgaaactggtagagtggtgtacgtgagtgatagtgtgactcctgtgctcaaccagccccagagtgaatggttcggttccaccctctatgatcaggttcatccagacgacgtagataaactgcgtgaacaactttctacctcagaaaacgctcttactggaagaatcctggatctcaaaaccggtactgtgaagaaagaagggcagcagtcatcgatgagaatgtgcatgggctctagacgcagctttatctgtagaatgcggtgcggcagctcatctgttgaccccgtatctgttaacagactaagctttgttaggaaccgttgtaggaacggccttggctctgtgaaggatggcgaaccacactttgtagtcgtacattgcactggatatataaaggcctggccccccgcaggggtgagcctgcctgacgacgacccagaagcaggccaggggtcaaagttttgcctggtggctattggtcgcctgcaggtcactagtagcccaaactgcaccgatatgagcaatgtttgtcagccgactgaattcatttcccgccataacatcgagggaatattcacgttcgtagatcaccgctgcgtggccactgtcggctatcaaccccaagaactgctgggaaagaatatcgtcgaattttgccacccagaagatcagcaactgctgcgtgactccttccagcaggtcgtgaaactcaaaggccaggtgttgagtgtgatgttccgcttccgctcaaagaaccaggaatggctgtggatgaggacttccagtttcacatttcagaacccgtactctgatgaaattgaatacatcatatgcactaatacaaatgtcaagaatagcagccaggagccccggccgacactgagtaataccatacagaggcctcaattaggaccaacagcaaacctgccacttgaaatggggtccgggcaacttgctccgagacaacagcagcaacaaacagaacttgatatggtccctggccgcgatggacttgcaagctacaaccactctcaagtcgtccagccagttactacaaccggacctgagcactcgaagcctctcgaaaagagcgatgggttgtttgcacaggacagagatcctagattctctgaaatatatcataatatcaatgccgaccaatctaagggaatttcttctagcacagttcctgccacacagcagctgttctctcaagggaacaccttcccgccaactcctaggccggccgaaaacttcagaaacagcggattggcgccaccagtgacgattgtccagcctagcgctagcgctggccagatgcttgctcagatctcccgccatagcaaccccacacagggcgcgaccccaacctggacccccaccactcgctccggattctcggctcagcaggttgctactcaagctacggctaagaccaggaccagccagttcggcgtcggcagctttcagactccttcctcctttagcagcatgtcacttccaggggccccgacagcctccccaggagctgccgcctacccttctttaaccaataggggcagtaacttcgcacctgagaccggccagacagccggccagtttcagaccagaaccgccgagggggtgggcgtctggccgcaatggcagggccaacagcctcaccatcggtcaagcagctctgagcagcatgtccaacagcctcctgctcagcaaccaggccagccagaggtctttcaggaaatgctgtccatgctaggagaccagagcaacagctacaataacgaggaattccctgatctgactatgtttcctccattttcagag

SEQ ID NO: 26104 - DNA, 2367 bp, Artificial Sequence
  Description of Artificial Sequence: Synthetic coding sequence
atggccgctactacggcaaatccagagatgaccagcgacgtcccctccttggggcctgccatcgcttccggcaacagtggccccgggatccaggggggaggcgcgattgtccagagagctatcaaaagaaggccgggactggacttcgatgatgatggagaggggaacagcaaattccttcggtgcgatgacgaccaaatgtccaacgataaagagcgcttcgcaaggagtgatgatgagcagtcatcagccgataaagagcgactcgccagagagaaccatagtgagatcgaacgccgaagacgaaataagatgaccgcctatattactgaacttagcgatatggtgcctacttgctccgccctggctcggaagcccgataaactgacaatccttcggatggcagtgtcccatatgaagtccctgaggggtacaggaaataccagcacagatggttcttacaagccgtctttcctgaccgatcaggagcttaagcatctgatactcgaggcagcggacgggtttctctttattgtgagctgcgaaacaggtagggtggtttacgtgagcgattccgtcacccccgtcctcaaccagccacagtccgaatggtttggctctaccttgtacgaccaggtgcacccagatgatgtcgataagctgagagaacaactgtcaacctccgagaacgcattgaccggaagaattctcgatcttaagaccggtacagtgaagaaggagggtcaacagagcagtatgagaatgtgcatggggtccaggagaagttttatctgcaggatgagatgtgggagcagctcagtggacccagtgtccgtgaatcggctctcttttgtgaggaatcgctgccgcaacgggttgggctctgttaaagatggcgaacctcactttgtggtcgtgcactgtactggctacatcaaagcatggccacctgccggggtatctctgccagatgacgaccccgaggccggtcagggcagtaagttttgtctcgtggccatcgggaggctgcaggtgaccagctccccgaattgtacagatatgtcaaacgtttgccagcccaccgagttcatctccagacacaatattgagggtatctttaccttcgtggatcatagatgcgttgccacagtgggataccagccccaggagctgctgggaaaaaacattgtagagttctgccacccagaagatcagcaactgctgagagattccttccagcaggttgtgaaactgaaagggcaggttttgagcgtgatgttccggtttcgctccaagaaccaggagtggctctggatgaggacttcaagctttacattccaaaacccttacagcgacgagatcgaatacatcatctgtaccaataccaacgtcaagaacagtagccaagaaccacggcccacgctctctaatactatacagcggcctcagttgggccccacggccaatttgcccctggagatggggagtggccagttggccccccgccaacagcagcagcagaccgaactcgacatggtgccaggtagagatggattggcctcctacaaccatagccaggtggtgcaacctgtcacaactacaggcccagagcactcaaagcctttggaaaaaagcgatggactgttcgcacaagatcgggatccgagattttcagagatttatcacaacataaacgctgaccagtccaagggtatctcctctagcaccgtgccagccacacagcagttgttctcacagggaaacacctttcccccaactcctagacccgctgagaacttccggaatagtggacttgccccacccgtaaccatcgtgcagccgtccgctagcgccggccaaatgctggctcaaatctctagacactccaaccccacacagggggctaccccaacatggaccccaacgacgcgctcagggttttccgcgcagcaggtggcgactcaagctacagctaagacgcggacaagccagtttggcgtcggaagcttccagacccccagctctttttctagcatgtctctgcctggagccccaaccgcatccccgggagctgccgcgtatccctctctgacaaatcgcgggagtaactttgctcccgagaccggacagaccgcaggacagtttcagacccgcactgcggagggagttggggtatggccccaatggcaggggcaacagccacaccacaggagtagctcaagtgagcagcacgtccagcagccaccggcccagcagcctggacagcccgaggtcttccaggagatgctgtccatgctgggtgaccagtctaacagctacaacaacgaggagtttcctgacctgactatgtttccccccttctctgag

SEQ ID NO: 26105 - DNA, 2367 bp, Artificial Sequence
  Description of Artificial Sequence: Synthetic coding sequence
atggcagccacgaccgctaatcccgagatgacttctgacgtgccctcactgggcccggctatcgcctcagggaactctggaccgggaatacagggcggcggagccatagtccaacgggccattaaacggaggcctgggctcgatttcgacgacgatggcgaaggcaatagtaagttcctgcggtgtgacgacgaccagatgtctaacgacaaggaacggttcgccagatccgacgatgagcagtcaagtgctgataaggagaggctcgccagagagaaccactcggagatagaacgcaggagaaggaataagatgacagcttacataactgagttaagcgatatggttcctacttgcagcgcgctggcacggaagccggacaagctgacaatattaaggatggcggtctcccacatgaagtcacttcgtgggacagggaataccagtaccgatgggtcttacaagccgtcctttctcacggaccaggagctaaagcatctaattctggaggcggctgatggatttctctttattgtatcatgcgaaaccggccgggtcgtctatgtctcggattccgtcacgccggtgctgaaccagcctcagtctgaatggttcgggagtacgctctacgatcaggtgcaccccgacgatgtggacaagttgagggaacaactgtcaacatctgaaaatgctctcacgggcaggatattggacttgaaaaccggaacggtcaaaaaagaggggcagcagtcctccatgcgaatgtgtatgggcagcagaagaagttttatatgccgcatgagatgtggttcttccagcgtcgaccccgtgtcagtgaaccgcctgagttttgttcgcaatcgatgccgaaatggtttgggctccgtgaaagacggagagccccacttcgttgtcgttcactgcaccggatacatcaaggcgtggccaccagctggtgtgtctttgcccgacgacgatccagaggctggccagggctctaagttctgcctggtggccattggaagactgcaggtaacttctagtcctaactgcaccgacatgtcgaacgtgtgccagcctaccgagttcattagccgccacaatatcgaagggatttttacgttcgtcgaccaccgttgtgtggccacggttggttaccagccccaggagctgctgggaaaaaatatcgtcgaattttgtcatcccgaggaccagcagctgctgagagactccttccagcaagtcgtgaagctgaaagggcaggtgctcagcgtcatgtttaggttcaggagtaaaaatcaggagtggctgtggatgcgaacttctagcttcaccttccagaacccctacagcgatgagatcgaatacattatttgcacgaatacaaatgtgaaaaatagctcccaggaacctcgtccaacgctgagtaatactatacaacggccacagctcggacccacagcaaatctgcctttggagatggggtctggacaattggcccccagacaacagcagcagcagaccgagctcgacatggtaccgggacgtgatggcctggccagctataatcatagccaggtcgtccagcctgtaaccacgactggccctgaacattccaagccgctggaaaagagtgatggtctgttcgctcaggacagggatccaaggttctctgaaatctatcacaatataaacgccgaccagtctaagggcatctccagctctacagtgccagccacgcagcaactcttctcgcagggcaatacattccccccaacacccagaccagccgagaactttcgcaacagtgggctcgcacctccggtcaccatcgtccagccttctgcgagtgctggacagatgttggcccaaattagccgacacagcaacccaacccagggtgcaacacccacttggacaccaaccacgaggtccggatttagcgcccagcaggtcgctacccaggctaccgccaagacaagaacctcccagttcggggtcggctcttttcagacgccatcctctttcagctcaatgagcctgcctggcgctcctacagcgtccccaggggccgctgcgtacccctcattgactaatcgagggagtaactttgctcccgagaccggccagaccgccggccagttccagacgcgcaccgcagaaggagtgggtgtgtggccccagtggcaaggacagcagccccatcaccggagctccagctctgagcagcacgtgcagcagccccccgcacagcaaccgggccagcccgaggtgttccaggagatgctgtctatgctgggcgaccagagcaacagctataacaatgaagagttccccgacttaaccatgtttcctcccttctctgag

SEQ ID NO: 26106 - DNA, 2367 bp, Artificial Sequence
  Description of Artificial Sequence: Synthetic coding sequence
atggccgccacaactgccaatccagagatgaccagcgatgtgccaagcctcgggcccgcgattgcatccgggaacagtggacccggcatccagggcgggggagcgatcgtgcagagggccattaagaggaggcccggactggactttgatgacgatggggaggggaacagcaaattcctccgctgtgacgacgaccagatgtctaacgacaaggagcgcttcgcacgctctgacgacgagcaatcttctgccgacaaggaacgactggcgcgcgaaaatcactctgagatcgaaaggaggcggaggaacaaaatgaccgcttacatcaccgaactctctgacatggtgcctacctgttctgcccttgcacggaagccggacaagctcactatcctgcggatggctgtgtctcacatgaaaagcctgcggggaaccggcaacacatccacagacggaagctacaaaccttccttcctcactgaccaagagctcaaacacctgatcctcgaggcggctgatggcttcctgtttattgtaagttgcgaaacgggacgcgtggtgtatgtttcagatagcgtgacccccgtgctcaaccagccccagtctgagtggttcgggagcactctgtatgaccaggtccatcctgatgacgtcgataaactccgcgagcaactgagcaccagcgagaacgctcttactggaaggattttggacctgaagaccgggactgtaaagaaggaggggcagcagtcctctatgcgaatgtgtatgggctccagacgctccttcatctgtagaatgcggtgcgggtcatcttccgtcgatccggtctcagtaaacaggctgtccttcgttcggaatcggtgcagaaatggcctggggtcagtgaaggatggggagccacatttcgtcgtggtgcattgcactggctatatcaaggcatggccacccgctggcgtgtcactccctgatgacgatcccgaagctggccaggggtccaaattttgtctggtggcaatcggtagattgcaggtgacttcaagtcccaattgtacagatatgtctaacgtctgccagccaactgagttcattagtaggcacaacatcgagggcattttcaccttcgtcgaccataggtgtgtggccacagtagggtatcagccgcaggagctgctgggaaaaaacattgtagaattctgccaccctgaggaccagcagttgcttcgcgactctttccagcaggtggtgaagctgaaaggacaggtcctgagtgtaatgtttcgcttccgatccaaaaatcaggagtggttgtggatgcggactagcagctttacgtttcagaacccatattccgacgaaatcgagtacatcatctgcacaaacacaaatgtcaaaaactcatctcaggagccacgcccaaccctgtccaacacaattcaaaggccccagctggggccgacggccaatctccccctggaaatgggatccgggcagctggcaccacgacaacaacaacagcagacagagctggatatggtccctggacgagacggtttggcgtcctataaccactcccaggtggtgcaaccagtcaccaccaccgggcctgagcactccaaaccgttggaaaagagcgacggcctcttcgcccaggaccgggatccaaggttctccgaaatatatcataacattaatgctgatcagtctaagggaatctcttcctctaccgtgcctgcgacccaacaactgttctcccagggaaatacatttccacctacacccaggcctgctgagaactttaggaatagcgggctcgcacctccggtgaccatcgtgcagccaagtgcttctgccggccagatgttggctcagatttccagacactccaatccaactcaaggcgccactccaacttggacgcccaccacccgatctggatttagcgctcagcaggtagctacacaggcaacggcaaagactaggacatcccaattcggcgttggaagcttccaaacaccatcctcttttagctctatgtcactgccaggcgcccctactgcctccccgggagctgccgcctacccttccctgaccaatcgggggtcaaatttcgcccccgaaaccgggcagactgccggacagttccagacacggacagcagagggtgtgggagtttggccccaatggcaaggccagcagcctcaccatcgcagctccagcagtgagcagcatgttcagcagccacctgcgcagcagcctggccagcctgaggtattccaggagatgctgtctatgctcggagaccagtccaatagctataacaatgaggagtttccagatcttacaatgttcccccctttttctgaa

SEQ ID NO: 26107 - DNA, 2367 bp, Artificial Sequence
  Description of Artificial Sequence: Synthetic coding sequence
atggcggcgacaaccgccaaccccgagatgacatctgacgtgcctagcctaggtcctgccatcgcatcagggaatagcggccctggcatccaaggtgggggggccatcgtgcagcgcgcaatcaagaggcgccccgggctggacttcgacgatgacggggaaggcaattcgaagtttttacgctgcgacgacgatcagatgagtaacgacaaggagcgcttcgcccgaagtgatgacgagcaatcctcagcggataaggaaaggctggccagggaaaatcactctgaaatcgaaagaaggaggcggaacaaaatgactgcatacattacagagttgtcggacatggtgccaacgtgcagcgcacttgcccgaaaacccgataagcttaccatcttaaggatggcagtgtcccacatgaagagtctcagggggaccggcaatactagcaccgatgggagctacaagccttcgtttctcactgatcaggagctcaaacatctcattcttgaggctgcggatgggtttctcttcatcgtcagctgcgagacaggccgagttgtgtacgtcagcgactccgtgacgccagttttaaatcagccgcaatctgagtggtttggcagtaccctttacgatcaagtacatcccgacgatgtggacaagcttcgagagcagttgtccacctccgagaacgccctcacagggcgcattctcgatctgaagaccgggactgtcaagaaagagggtcaacagtctagcatgagaatgtgcatggggtctcggcggtctttcatctgccggatgcgctgcggttcctcttcagttgatcccgtaagcgtcaaccgcctttcttttgtaaggaaccgatgtaggaacggcctggggagcgtgaaggatggggaaccccactttgtagtggtgcactgtaccggctacatcaaggcctggccacccgcgggggtttcccttcctgacgatgacccagaggcagggcagggcagcaaattctgcctagtggctatcggacggctgcaggtgaccagttctccaaactgcacagacatgtcaaacgtttgccagccaacagagttcatcagcagacacaacatcgaagggattttcacgtttgttgaccatagatgtgtggcgaccgtaggttaccagccccaggagctcctcggtaaaaatatagtggaattttgtcaccctgaggaccagcagttactcagagactctttccagcaggtcgtgaagctgaagggtcaggtgctgtccgtgatgttccggttcagatccaagaaccaggagtggttatggatgaggacatcgtcattcacctttcagaacccctacagcgacgaaatcgaatacatcatttgcacaaatacaaatgtgaagaacagttcccaggagcctaggcccacgctgtctaatacaatccagaggccacagctgggacccactgctaacctgccactggagatgggcagcggacagctcgccccaagacagcagcagcagcagacagaactcgacatggtgccagggagagacggcctagccagctacaaccattctcaggtggttcagcccgtgaccacgactgggccagaacattctaagcccctggagaagtctgatgggctctttgcccaggaccgtgaccccaggttctcagagatctatcacaatatcaatgcagaccagtcaaaaggcatttcaagctccacagtgccggctacacagcaactgtttagccagggaaacaccttccctcctactcctcggccagctgagaatttccgaaactcgggcttggcaccacccgtgaccatcgtacagccttccgccagcgctggccagatgctggcacaaatttcacgtcactctaacccaacacaaggagccactcccacttggacaccaactacacggagcgggttctcagcgcagcaggtggccacccaggcaactgcgaagactcgaacgtcacagtttggagtaggatcctttcagacgccaagctcatttagctcgatgagcctccctggggctcccacagcatctcctggtgcagctgcctatcccagtctgacaaaccgcgggagtaactttgcgcccgagacgggacagactgccggacagttccagactagaaccgctgaaggggttggagtgtggcctcagtggcagggtcagcagccgcaccatcggtcttcctcctccgagcagcacgtgcagcagcccccggcacagcagcccggtcaaccagaggtgttccaggagatgctatctatgctgggtgaccaatcgaacagctataataatgaggagttccccgatctgacgatgttcccgcccttttctgaa

SEQ ID NO: 26108 - DNA, 2367 bp, Artificial Sequence
  Description of Artificial Sequence: Synthetic coding sequence
atggccgctaccaccgcgaaccccgaaatgaccagcgacgtcccaagcctgggaccagccatcgccagcggaaatagcggaccgggaattcaaggtggcggagccatcgtccagagagccatcaagaggaggcccggtctcgacttcgatgacgacggcgaaggcaactctaaatttctgcgctgcgacgatgatcagatgagcaacgataaggaacgtttcgcacgctctgatgatgaacaaagctctgctgacaaggagagactggctagggagaatcactcagagattgaaaggaggcgccggaacaagatgaccgcctatataaccgagctgtctgacatggtacctacctgcagtgctttagccagaaagccggataagcttacaatccttcgcatggctgttagccacatgaagagcctgcgcggcacaggaaatacgagcaccgatggtagctacaaaccttcatttctcacagaccaggagttgaaacatttgatactggaagccgctgacggcttcctttttattgtcagttgtgagactggcagagtggtttatgtgtcggactctgtcactccggtgctgaaccagccgcaaagtgagtggtttggatccactctttacgatcaagtgcatccagatgatgttgacaaattgcgggagcagctgagtacctccgaaaacgctctgacaggacgaattctggatttaaagactggcactgttaaaaaggagggccagcagtcgagtatgcgcatgtgtatgggcagcaggcgctcctttatctgtcgtatgagatgcggaagcagcagcgttgatccggtcagcgtgaatcgacttagctttgttagaaacagatgccgcaatggtctgggcagcgttaaggacggtgaaccgcactttgtggttgtgcactgtactggttatattaaggcatggccacctgctggtgtctccctgccggacgatgatccggaggccggacagggctccaaattttgtcttgtcgcaatcggaaggttgcaggtcacatcgtctcctaactgtaccgacatgtcaaacgtctgtcagccaaccgaattcatcagcaggcataacatcgaaggcatctttacatttgttgaccacaggtgcgtcgccacggtggggtatcagccacaggaattgctgggaaaaaacattgtcgaattctgccacccggaggaccagcagctgctgagggactcctttcaacaagtggttaagctgaaaggtcaggtcctttccgtcatgttcagattccggtccaagaatcaagagtggttgtggatgcggaccagctcttttacatttcagaacccatacagtgacgagattgaatatatcatatgcaccaacactaacgtcaaaaatagtagccaggagccacggcccaccctgtctaataccatacaaagacctcagttgggacctaccgccaacctgccccttgaaatggggagcggacagctagcaccgagacagcaacagcagcaaaccgaactggacatggtgcccggaagggatggcttggcgtcttataatcactctcaggtagttcagcctgtgactactactgggcccgagcactctaagcctcttgaaaagtcagacggcctttttgcccaggatcgcgatcctaggttcagcgagatctatcacaacatcaacgccgatcaaagcaaaggaatctctagcagcaccgtgcctgctactcagcaactgtttagtcaaggcaacacttttccacctacaccaaggcccgctgaaaactttaggaattcgggcttagcgccgccagtgaccatagtccagccctccgcctccgctgggcagatgcttgcacagatcagcagacacagcaaccctacccaaggtgctacccccacatggacaccaaccactaggtcaggatttagcgctcaacaggtggccacccaggcaaccgctaaaacaaggaccagtcagtttggagttggctctttccagaccccatcctcttttagtagcatgagtttgcctggagctcccaccgcctctcctggggcagctgcataccccagtctcacaaacagaggcagtaattttgccccggagactggacaaactgctggtcagttccagactcggacagctgagggggtcggcgtctggcctcagtggcaggggcagcaaccacaccacaggagctctagctctgagcaacacgtccagcagccccctgctcaacagcccggtcaacctgaagtgtttcaggaaatgctaagcatgctcggggaccagtccaattcatataacaatgaagaattcccagacctgaccatgtttcccccattctcagaa

SEQ ID NO: 26109 - DNA, 2367 bp, Artificial Sequence
  Description of Artificial Sequence: Synthetic coding sequence
atggccgcaacaacggccaatcctgagatgacttctgatgttccctctcttgggccggctattgctagcgggaacagcgggcccgggattcaaggtgggggagccatcgtgcagagagctatcaagcgacgccccggcctggatttcgatgatgacggcgaggggaattccaaattcctccggtgcgatgatgatcagatgagtaatgacaaagaacgattcgctcgcagtgacgacgaacaatcctctgctgataaggaaagactggccagggagaaccactccgagatcgagagacgccgcagaaacaagatgacagcctacatcaccgaactgtccgacatggtgcctacctgcagtgcactggccaggaagccagataagcttactatcttgcggatggccgtcagtcacatgaagtctctcaggggcactggcaacactagcacagatgggtcatataaaccgtccttcttgacagatcaagagctgaaacatttgatattggaggccgccgatggcttcctgtttattgtgtcttgtgagaccggccgcgtagtatacgtgagcgatagcgttactcccgtactcaatcagccgcaatctgagtggttcgggagtacgctttacgatcaggtgcacccagacgacgttgataagctgcgcgagcagctttccactagcgaaaatgctctcacaggccgcattcttgatctgaaaacgggaacggttaaaaaggagggtcagcaatccagcatgcgaatgtgtatgggctcacggaggtcttttatttgtcgcatgaggtgcggttccagcagtgtcgatcccgtgtcagttaaccgacttagctttgtccggaatcggtgtcggaatggactgggtagtgtgaaggatggcgagccacactttgtggtcgttcactgcaccggttatatcaaggcttggccaccagccggtgtctccctgcccgacgacgaccccgaggcaggacaaggatctaaattctgcttggttgctatcggaaggctgcaggtgacctccagcccgaattgcaccgacatgtccaatgtgtgccagcctaccgaatttatctctaggcacaacattgaaggtatatttactttcgtagaccacaggtgcgttgccaccgtgggctatcagccacaagagctgctgggcaagaacatcgtcgaattttgtcatcctgaggaccagcagctgctccgggacagcttccaacaggtggttaagttgaaggggcaggtgctctctgtgatgttccggtttcggtctaagaatcaggagtggctgtggatgaggacaagcagctttaccttccaaaatccctactccgatgaaatcgaatacattatctgcacaaatacaaacgtgaaaaattcaagtcaagagccccgccctactcttagtaatactatccagaggccacagctcggcccaactgccaacctgccactggagatggggtccggtcaactggctcctagacaacaacagcaacagaccgagctggacatggtgcctggccgcgacggcctcgccagttataatcacagtcaggtcgtacagcctgtgaccacaactggcccagagcactctaagccactggagaaatcagatggactttttgcacaagaccgggatcccaggttttccgagatctaccataatattaatgccgatcagagtaagggcatatcaagcagtaccgtaccggcaacccagcaactcttttcccagggaaataccttcccaccaacgccacggccagccgagaacttccgaaactctggactggccccacctgtaaccattgtacagcccagcgccagcgcaggacagatgctggcccagatttcacgacattctaatcccacacaaggcgcaacccccacatggaccccgaccacccgctcaggcttcagcgcccagcaggtggccacacaagcgaccgccaaaacacgcacatcccagttcggggtgggttccttccagactccatcatctttttccagcatgtccctcccgggagctcccacagcctctcccggggccgctgcctatccttcattgactaacagaggcagcaactttgccccggaaacgggtcagactgccgggcagttccagacaaggactgctgagggggtgggcgtgtggcctcagtggcaggggcagcaaccccatcatagaagctcttcaagcgagcaacacgtccagcaaccccccgcgcagcagccggggcagccagaggtctttcaagaaatgctctccatgctgggggatcagtccaatagctataataatgaagagtttccagatctgacaatgttccccccattcagcgag

SEQ ID NO: 26110 - DNA, 2367 bp, Artificial Sequence
  Description of Artificial Sequence: Synthetic coding sequence
atggcagctactactgctaatcctgagatgacctccgatgttccctccctcggacccgccatcgctagtggaaattcagggcccgggatccaggggggcggggcaatcgtgcagagagccattaaacgtaggccgggcttagacttcgatgacgacggcgaggggaactcaaagttcctgaggtgcgatgacgaccagatgagcaatgacaaggagcgcttcgcgcgatctgacgatgaacagagctcagccgataaggaaagactggctcgagagaatcattccgagatagagcggaggaggcggaataagatgactgcatacattactgagctcagtgatatggtgccaacctgctccgctctcgcgcgtaagccagataaattgactatcctcagaatggccgtctcccacatgaagtctctgagaggtaccggcaacacctctaccgatgggagctacaagccctccttcctgactgaccaagaactgaagcatctgatactggaggcggccgacgggttcctgtttattgtgtcttgtgagacgggtagggtggtctatgtcagcgattcagtcacaccagtcctcaaccagcctcagtcagaatggtttggatcaaccttgtatgatcaggttcaccccgatgacgtggataagctgcgcgagcagctgtctacgtccgagaatgcgttgacaggtagaatcctcgacctgaagaccgggactgtgaaaaaggagggccagcagtcctcaatgagaatgtgtatgggaagtcggcggtccttcatttgccgtatgcgatgcggatcttctagcgttgaccccgtaagtgttaacaggctatctttcgtgcgaaaccgatgcaggaacggtctgggatccgtgaaggacggggaacctcatttcgtggtcgtgcactgtacagggtatattaaggcgtggccccccgcgggcgtgtcgcttccagacgatgatcctgaggccggccagggctctaagttctgtcttgtggcgattggtcggctgcaggtcactagcagccctaactgcaccgatatgtctaacgtgtgccagcctaccgaattcatctcgaggcataatattgagggcatttttaccttcgtcgatcaccggtgtgtggctaccgtggggtaccaaccacaggagctgttggggaagaacatcgtagaattctgccatcctgaggatcagcagctgctgcgggactcatttcagcaggtggtgaagctgaagggacaggtgctctccgtaatgttcaggttcaggtctaaaaaccaagaatggctttggatgcgaaccagttctttcaccttccaaaatccatacagtgatgagatcgagtacataatttgcactaacaccaatgtaaaaaatagtagccaagaaccccggcccacactctctaacactattcagcggccacagctggggccaacagcaaatctgcctctcgaaatgggcagcggacagctggcacccagacagcagcaacagcaaactgagctggacatggttccaggccgcgacggcctagcctcatacaaccatagccaggtggtccagcccgtgacgaccactggccccgagcactcgaagccattggagaaatccgacggactgtttgcccaggatagagacccccgattttcagaaatctatcacaatatcaatgcggaccagagtaaaggtatctcttccagtacagtgccagccacacagcagctattttctcaaggtaacacgtttcctccaactccccgaccggccgaaaattttagaaattccgggttagccccaccagtgacgatcgtgcaaccgagcgcgtctgctggacagatgttggctcagatctcgcggcattcaaatcctacccagggagccacgcctacgtggaccccgactaccaggagtggattctcggcacagcaggtcgctacacaggctacagccaagaccagaacatcacagtttggtgtgggatcttttcagacgcccagctcattttcatccatgtctttgccaggagcaccaaccgcatcccccggcgctgcagcgtaccctagcctgactaataggggcagcaattttgccccagaaaccggacaaaccgccgggcagtttcaaactagaacagcagagggggtcggagtctggccccagtggcagggccagcagccccaccataggagtagttcaagtgaacagcatgtccagcaaccccccgcccagcagccgggccagccagaggtcttccaggagatgctgtccatgctcggggatcagagcaacagctacaataacgaagagtttccagacctcaccatgttccccccgttcagtgag

SEQ ID NO: 26111 - DNA, 2367 bp, Artificial Sequence
  Description of Artificial Sequence: Synthetic coding sequence
atggccgccacaacagcaaaccccgaaatgacctcagacgttccttctctgggccctgctatcgcttccggcaatagcggccctgggatacaaggaggcggggctatagtgcaaagagccataaaacggcgcccaggtctggattttgacgatgacggggagggcaattccaaatttctcaggtgcgacgacgaccagatgtctaatgacaaggagcgattcgcacgttcagacgatgaacagtcctctgctgataaggaacgtctggcacgggaaaaccatagcgagattgaacggcggcggaggaataagatgaccgcctacataacagaattgagcgacatggtcccaacgtgcagtgccctcgctagaaagccggataaattgactatcctcagaatggcagtgtcccacatgaaatccctaagaggcaccggaaacacgtccaccgacggctcgtacaagccatctttcctgaccgatcaggaactgaagcatctcatcttggaagctgcggatggcttcctctttatcgtgtcttgcgagacagggcgggtggtgtatgtgtctgacagtgtcacccctgtattgaaccaacctcagtcagagtggttcgggtctactctgtatgatcaggtgcaccccgacgacgtggataagctgagggagcaattatcgacatccgagaacgcgctcaccgggcgcatccttgacctgaaaaccggtaccgttaagaaagagggccagcagtcctctatgaggatgtgcatgggttctcgccgatcttttatctgtcgaatgcgttgcggatcctccagcgtcgatccagttagcgtgaatcggctcagctttgtgcgtaatcgatgtcggaatggtttgggaagcgttaaggacggggagccacattttgtggtggttcattgcacgggctacataaaagcatggccccctgcaggcgtctctctgccagacgatgatcccgaagccggacagggcagtaagttctgtcttgttgcaatcggccggttacaggtgacctctagtccgaattgcaccgatatgagtaacgtgtgtcagcccacggaatttataagtcgccacaacattgagggaatattcacttttgtggatcaccgctgtgttgcgaccgtgggctatcagcctcaagagttgttgggcaagaacattgtagagttttgtcaccctgaagatcagcagcttctacgcgattccttccagcaggtggtcaagttaaagggccaggtactgtccgtgatgttcaggttcaggtccaaaaaccaggagtggctgtggatgagaacttcatcattcacctttcagaatccctacagtgatgagatcgagtatattatttgtaccaatacaaacgtgaagaatagcagtcaggaacccagacctacccttagcaacaccattcaaagacctcaactaggaccaaccgccaacctccctctggagatgggatctggacaactggccccacgacagcaacagcagcagaccgagctggacatggtcccaggccgagacggcttggcttcgtacaaccacagccaggttgtgcagccagtcacaaccactgggcccgagcactctaaacctctcgaaaagtccgacgggctcttcgcccaggatcgggatccacgcttctctgagatataccacaatattaacgctgaccagtctaagggcatcagttccagtacggtgcccgcgactcagcagctgttctcccagggcaatacatttccaccaacgccccgccccgccgagaactttcgcaactctggcctcgccccaccggtgactattgttcaaccaagtgcgagcgccgggcagatgctggcccaaatttcacgccacagcaatcctactcagggagcaactccgacttggactcccactacccggagtgggttctctgcgcagcaggttgccactcaggctaccgccaaaaccaggacaagtcagttcggggtcggctcttttcagactcccagctctttttctagcatgtcccttccgggggcgcccacagcctctcccggtgcagcagcttaccctagcctgaccaatcgcggaagcaactttgcaccggaaactggacagactgccgggcagttccagactaggacggctgaaggcgtgggcgtctggcctcaatggcaaggccagcaaccccatcatagaagttcttctagcgagcagcacgttcaacagccccctgcgcaacaaccgggtcagcccgaggtcttccaggagatgctctccatgctaggagaccaatccaatagttacaacaacgaggagtttcctgacctgacaatgtttccgccatttagcgaa

SEQ ID NO: 26112 - DNA, 2367 bp, Artificial Sequence
  Description of Artificial Sequence: Synthetic coding sequence
atggcagccacaacagcaaaccccgaaatgacttccgatgtaccttctctgggtcccgcgatcgcgtctggtaactctgggcccggcatacagggaggtggcgcgattgtgcagcgagccattaagagaaggccgggccttgactttgacgatgatggtgaaggtaactcaaagttcctgagatgcgatgatgatcagatgtcaaacgataaggagcgcttcgccagatccgatgacgaacagagcagtgccgataaggagcgccttgcaagagaaaatcactctgagattgagaggagacgccggaacaaaatgaccgcctatattaccgagctgtctgatatggtgccaacatgcagtgcccttgcacgcaagcctgacaagcttaccatcctgaggatggccgtcagccatatgaagagcttgagaggaaccggtaacacgagtacagacggtagttacaaaccgagcttcctcacagatcaggagctgaagcatctcatcctggaggcagccgatgggttccttttcattgttagttgcgagacagggcgcgtggtgtatgtcagtgacagtgtgacacccgttctgaatcagccacagtctgagtggtttggttctaccctttatgatcaagtgcacccagacgatgtggacaagctgcgggaacagctgtcaacatccgagaacgctttgaccgggagaatcttggatctcaagaccgggactgtcaagaaggagggacaacagagcagtatgcggatgtgtatgggttcccgaagaagtttcatctgccggatgcgctgtgggagctcctctgtggaccctgtgtccgtgaacaggctgagttttgtccggaacagatgcaggaatggcctgggctcagtcaaagatggtgaaccgcacttcgtcgtagtgcactgcactggatatataaaagcatggccccccgccggagtgtcactgcccgatgacgaccctgaggccggtcagggatcaaaattctgccttgtcgcaattggtaggttgcaggtgactagttcaccaaattgcacagacatgtccaatgtgtgccagccaactgaatttatctcccggcacaacattgaagggatcttcacgttcgtggaccacagatgcgtggcaaccgtcggctatcaacctcaagaactcctgggaaaaaacatagtggaattttgccatccggaagaccagcagctcctcagggactcctttcagcaggtggtgaagctgaagggccaggtcttgtctgttatgttcagatttcggagtaagaaccaagaatggttgtggatgagaacatcctccttcacgtttcagaacccatactccgatgaaatcgaatacatcatatgtaccaatacaaatgtaaagaatagcagccaggagcctcgcccgacgctctctaacactatccagcggccacagctggggcccactgctaacctgcccctggaaatgggaagtggacagctggccccccgccagcagcagcaacaaacagaacttgacatggtccctggccgcgacggcctggcttcttacaatcatagtcaagtcgtgcagcccgtgaccacaaccggcccggaacattccaagcccctggaaaagtccgatggcctgtttgcacaggaccgcgacccacgcttcagcgagatctaccataatatcaatgcagaccaatcaaaaggtatctctagcagcaccgtacctgccacccagcagctgttctcccaggggaacacattcccacccactccacgccctgcggagaactttagaaactcaggcctggccccacctgtgaccatagtgcagccaagcgcatcagccggccagatgctggcccagatctcccgccactctaaccctactcagggtgctaccccaacatggacacccaccaccaggagcggatttagcgcacagcaggtggctacccaggctaccgctaagacaaggaccagccagtttggggttggaagctttcaaaccccttcatctttcagttccatgtccctcccaggcgcacccaccgcctcccccggggcggcagcctaccccagcttgacgaacaggggcagtaacttcgcacctgagactgggcaaaccgccggacagtttcagactaggactgctgagggggttggggtatggcctcaatggcaagggcaacagccacaccatcgaagttcttccagcgagcagcacgtccagcagccccccgcccagcagcccggccaacccgaagtcttccaggagatgttgtccatgctgggcgatcagtccaactcctacaacaatgaggaattcccagatctcaccatgttcccacctttctccgaa

SEQ ID NO: 26113 - DNA, 2367 bp, Artificial Sequence
  Description of Artificial Sequence: Synthetic coding sequence
atggcggctacgactgctaacccagaaatgactagtgatgtgccctctctagggcccgcgatcgcctccggaaattccgggccaggaatccagggaggaggggccatcgtgcagcgagctatcaaaaggcgacccgggctcgactttgatgatgatggggaaggaaatagtaaattcctgcggtgtgatgatgatcagatgagtaatgataaggagcgattcgcacgatcggacgatgaacagtcctctgctgataaagagcgcctagccagggagaatcattcagagatagaacggaggcggcggaacaaaatgacagcctatatcacagagctatcggatatggtacctacatgcagtgcactcgcaagaaaacccgataaactgactatcttgcggatggctgtatcccatatgaaatcactgcgggggacaggaaatacttcaactgatggatcttacaaaccctccttcctgacagatcaggaactaaaacatcttatcctcgaagctgcagatgggtttttgtttatcgtcagttgtgaaacaggaagggtggtctatgtatctgattctgtgactcccgtgctcaaccagccacaatcagagtggttcggatccacactatacgatcaagtgcatcctgatgacgtggataaactaagagaacagctctctacatctgagaatgcactcactggaagaatactcgatctaaaaacagggacagtgaaaaaagaaggacagcagagttccatgcggatgtgtatgggatctcgcagaagtttcatctgtagaatgcggtgtggatcttcatccgtagatccagtcagtgtaaaccgcctgtcattcgtgagaaatagatgccggaatggactgggatcagttaaagatggggaaccacatttcgtcgtggtgcattgcacagggtacataaaagcttggccaccagctggagtatcgctgccagatgacgatcctgaagctggacaggggtctaaattttgcctcgtggcaataggacgcctccaggttacatcctctcccaactgtactgatatgtcaaatgtatgtcagcccacagaatttatctcacgccataatatagaggggatattcacgtttgttgatcaccgctgtgtggcaacagtgggataccagccccaggaactactcgggaagaatatcgttgaattctgtcaccccgaagatcagcagctgctaagggattcatttcagcaggtggttaaactgaaagggcaggtactctccgtgatgttccggttccggtcaaaaaatcaggaatggctctggatgaggacatccagttttactttccagaatccttactctgatgaaattgaatatatcatatgtacaaatacaaacgtgaaaaactcttctcaggaacctagacccacactgtctaatacaatccagaggccacagctgggacccactgctaatctccctctggaaatgggatccggacagcttgcaccccggcagcaacaacagcagactgaacttgacatggttcctgggcgggatgggctggcctcatataaccattcccaagtcgtccagccagtcactacaactggacccgaacattctaaacccttggaaaagagtgatggacttttcgcacaggatagagatcctaggttttctgagatatatcataacattaatgccgatcagagtaaaggaatctcatctagtacagtgcccgctacacagcagttattctctcagggaaacactttcccccccactccccggcctgccgaaaacttcagaaattccggactcgcccctcccgtcacaatcgtgcagccatcagcctcagctgggcagatgcttgcccagatctccaggcactctaatcctacacaaggggctacacccacttggactcctacaacgcggtcagggtttagtgctcagcaggttgcaacacaggccacggctaaaactcgcacatcccaattcggagtggggtcctttcagacacccagttcattttcctctatgtctttgcccggggcgcccactgcatcacccggagctgctgcctacccatcactaacaaaccggggatctaattttgcccccgaaactgggcagacggccgggcagttccagacaagaactgccgagggggtcggggtttggccacagtggcaggggcaacagcctcaccatagatctagttcctccgaacagcacgtgcagcaacctcctgcacagcagcccggacagcccgaagtgttccaggaaatgctctcgatgctcggagatcagtccaactcctataataatgaagaatttccagacttgacaatgtttccacccttttccgaa

SEQ ID NO: 26114 - DNA, 2367 bp, Artificial Sequence
  Description of Artificial Sequence: Synthetic coding sequence
atggcggccactactgcaaacccagagatgactagcgatgtgccatcactcggtcctgctatcgccagcggcaattccggcccaggcatccaaggcggaggagccatcgtgcagagggctataaaaagaaggccaggacttgactttgatgatgatggcgaaggcaatagcaaatttctgcggtgcgacgacgatcaaatgtcgaacgacaaagagaggtttgccagaagcgatgatgagcagagcagcgcagacaaagaaagacttgctcgggagaaccactccgaaatcgagagacggcggaggaataagatgacagcctatatcactgaacttagcgacatggttccgacatgttctgctctagctcggaagcctgataagctgacaatcttgcgaatggcggttagtcatatgaagagtctgagagggacaggtaacacctccaccgatggctcgtacaagccctctttcctcactgatcaagagctgaagcatctcatcctggaagctgccgacgggttcctttttatcgtgagctgcgagaccgggcgcgtggtttacgttagcgacagtgtgactcctgtcttaaaccagccacagagtgagtggtttggatccactctgtacgaccaggtccaccctgacgatgtggacaaactgagagagcagctcagcaccagcgagaacgcactgacaggaaggatattggacctgaaaacaggaacggtaaagaaggagggacagcaaagctcaatgaggatgtgcatgggctctagaaggtctttcatttgccggatgaggtgcggatcctcatctgtagaccctgtgagcgtcaaccgccttagcttcgtgagaaacaggtgccgcaacggactcggtagcgtcaaagatggcgaaccgcactttgtcgtggtgcactgcacgggttatatcaaggcgtggccacctgccggagtctcccttcctgacgacgaccctgaggccggccaggggtctaaattttgtctagtggctatcggaagactccaggtcacgtccagtcccaactgcactgatatgtccaacgtgtgtcagcctaccgagtttattagcagacataacatcgagggaatatttaccttcgtagatcatcggtgtgtcgctaccgtgggttaccaacctcaggaactactgggaaaaaatatcgtggagttctgccatccagaggaccagcaattactgagagacagcttccaacaggtcgttaagctgaaaggacaagtgttatctgttatgttcaggttcagatctaaaaaccaagagtggctttggatgagaacctcctcatttacattccagaatccttattccgatgagattgaatatattatctgtaccaatactaacgtgaaaaatagttcccaggaaccaaggccaacattaagtaataccatccagcgcccacagctggggcccacagctaacctgccattggagatggggtccggacagctcgctcctagacaacagcagcaacagacagagctggatatggtgcccggccgggatggacttgcaagctacaaccacagccaagttgtgcagcctgttacaactactgggcctgagcactccaagcctctcgagaaaagcgacggcctctttgctcaggatagagatcctagattcagtgagatataccataacattaacgctgatcagtctaagggaatatcgagcagtactgtgccagccacacagcaactcttttctcagggcaatacttttccgcccactccccgccctgcagagaattttaggaactccggcctagctcctccagtgaccatcgtacagcctagtgcaagcgccggacaaatgcttgcacaaatctcgcggcatagcaatccaactcagggagccacaccaacatggaccccgacaacccgatcaggttttagcgcccagcaagttgctacacaggccaccgcaaagaccaggacatcccaattcggagttggaagcttccagaccccaagcagcttctcatccatgagcctgcctggagctcctaccgctagccctggagcagctgcctacccctccctcaccaaccgcgggagcaactttgctccagagacaggtcaaaccgccggccagtttcaaacccgcaccgccgaaggagtgggcgtgtggccccagtggcagggacagcaaccccaccacaggagtagctcatcagaacagcatgttcagcagccgcctgcccagcaacccggccagcctgaagtctttcaggagatgttgtctatgctcggcgaccaaagtaacagctacaataatgaggaattccccgacctgaccatgttccctccatttagcgag

SEQ ID NO: 26115 - DNA, 2367 bp, Artificial Sequence
  Description of Artificial Sequence: Synthetic coding sequence
atggccgcaaccactgctaacccggagatgacctcagacgtgcctagcttagggcccgccatagccagcgggaattcaggtccagggatccaagggggcggcgcaatcgtccagagggccattaagaggaggcctggccttgattttgacgatgatggagagggaaatagtaagtttttgcggtgtgacgatgatcagatgagtaacgataaagaaaggttcgccaggtccgacgacgagcaaagctcagccgacaaggagagattggcgcgggagaaccactccgagatcgaacggcggaggcgaaataaaatgactgcatacatcaccgaactctcagatatggtgccgacatgttctgccctcgctcgcaaacctgataagttgaccattcttcgcatggccgtgtcccatatgaaaagtcttcgcggaacaggcaacacttccacagatggaagctataaacctagtttcctcaccgatcaagagttaaaacatctgatcctcgaggctgccgacggttttctgtttatcgtctcatgcgaaaccggcagggtagtatacgtgagcgactctgtcacccccgtgttgaatcaaccccagtctgagtggtttggcagcaccctctacgaccaggttcaccctgatgacgtcgataagctccgcgagcagctgtctacatcagaaaatgcactgaccggccgtattctcgacctgaaaaccggtaccgttaagaaggaggggcagcaatcaagcatgcgcatgtgtatgggctcaagacggtccttcatctgcaggatgagatgcggttcaagcagtgtggacccagtaagtgttaatagactgagttttgtgcgcaacagatgcagaaatgggctcggatctgtcaaagatggagagccccacttcgtcgtggtgcactgcaccgggtacattaaggcatggcccccagcaggggtgagcctgccagacgacgatccagaggccggacaagggtccaaattctgcctggtcgcaatcggacgtctgcaagtaacaagctcccccaattgtaccgatatgtcaaacgtgtgtcagccgacagagttcatctccaggcataacatcgagggcatattcactttcgtcgatcaccgttgtgtggccaccgtgggctatcagcctcaagagctcttgggcaagaacatcgtagagttttgccacccagaagaccagcaactgttgcgtgacagcttccagcaagtggtgaagctcaagggccaggtgttaagcgtcatgttccgattcaggtcaaaaaaccaagagtggctgtggatgagaactagttcatttacttttcagaacccgtatagtgatgaaattgagtacatcatctgcaccaatacaaatgtgaaaaacagctcccaggaaccaagaccaaccctgagtaacaccattcagcgtccgcagctcggccctactgcgaatctgccactcgaaatggggtctggccaattggctcccaggcagcagcagcagcaaaccgagttagatatggtcccgggcagggatggcctcgcttcttataatcactcacaagttgtgcagcctgtgaccactactggccccgaacactccaaaccactcgagaagagcgacgggctctttgcccaggacagggacccccgattttcagaaatctaccataatatcaacgcagaccaaagcaaggggatcagttcaagcaccgtgcctgctacacagcagctgttctctcagggcaacaccttcccacctaccccacgtccggcggagaactttcggaactccgggctggctcctcctgtgacaatcgtccaaccgagtgccagtgcagggcaaatgctggctcagatcagccgccactctaacccgacccagggcgccacacccacctggaccccgaccaccaggagcggattcagtgctcagcaggtagctacgcaggccaccgctaagactcggacctctcaattcggagttggctcctttcagactccctcctccttttctagcatgtctttaccaggggcacccacagctagccccggcgccgcggcctatcccagcttaaccaatagaggctctaactttgcgcctgaaacaggacaaactgctggacagttccaaacacggactgccgagggggtgggtgtctggccacagtggcagggccagcagcctcatcataggtcctcctcatctgaacagcacgtgcagcaaccaccagcacagcagcccggtcagcctgaggtctttcaggagatgttgtccatgctgggcgaccagtccaactcctataacaatgaagagttcccggatctgacgatgttcccaccattcagtgag

SEQ ID NO: 26116 - DNA, 2367 bp, Artificial Sequence
  Description of Artificial Sequence: Synthetic coding sequence
atggcggcaactaccgccaatccggaaatgacctcggatgtcccgtccctcggacccgccattgcctccgggaactctggaccgggaatccaggggggaggcgccatcgtgcagagagccatcaagagacggccaggcctcgactttgacgatgatggtgaaggcaactcgaagtttctgagatgcgatgacgatcaaatgtcaaatgataaagaaagattcgcaagatccgacgacgagcagtcgtccgcggacaaggaacgcctggccagggagaaccattccgaaattgagcgccgtcgccgcaacaagatgaccgcgtacatcactgaactgtctgatatggtgccgacttgcagcgcccttgctagaaaaccagataaactgactattctccggatggccgtgtcccacatgaaatcgctgcgtgggaccggaaacacttcaacggacggctcgtataagccttcgtttctgaccgaccaagagttgaagcatctcatcctcgaggccgcagatggattcctgtttatcgtcagctgcgagactggtagagtggtgtacgtgtcggactcggttaccccggtgctcaatcagcctcagtccgagtggttcggcagcactctgtacgatcaagtgcatccggacgacgtggataagctccgggaacaactctcaaccagcgaaaacgcgctcactggacggatcctcgacttgaaaaccggaactgtgaagaaggaaggacaacagtcaagcatgcggatgtgcatgggaagccgacgctccttcatctgtcggatgcggtgcgggtcgtcctcggtcgaccctgtgtcggtgaaccgcctgtcatttgttcggaaccgatgccgcaatggacttggatccgtgaaggacggagaaccccactttgtcgtcgtccactgtaccggatacatcaaggcctggccacctgccggagtgtcgctgcccgacgacgacccggaggctggacagggctcgaagttctgcctcgtggctattggaaggttgcaagtcacgagctctccaaattgcacggatatgagcaacgtgtgccaaccgactgaattcatcagcagacataacatcgagggaatcttcaccttcgttgaccaccggtgtgtggctacggtgggctaccagccacaagagctgctgggaaagaacatcgtggagttttgccacccggaggaccagcaactgctcagggattccttccaacaggtggtgaagctgaagggccaggtgctgtcggtcatgttccggttccgctcaaagaatcaggagtggctgtggatgcgcacctcgtcattcactttccaaaacccgtactccgatgaaatcgaatacatcatttgtaccaacacgaacgtgaagaacagcagccaggaacctcggccgaccctttccaataccatccagcgcccacagttgggaccaaccgcgaaccttccgctggaaatggggtcgggacagctggcgcctcgccagcagcagcagcaaacggaactcgacatggtgccgggtagggacggactggcctcctacaatcacagccaggttgtccagccagtgactactactggcccagagcactcaaaaccgctggagaaatcggacggacttttcgcacaagacagagatccgcggttttcggaaatctaccacaacatcaatgcggatcaatcaaaggggatctcatcatccactgtgcctgccacccaacaactgttcagccaaggcaatacctttcctcccaccccgaggccagcagagaacttccgcaactcaggcctcgcgcctccggtcacgatcgtccaaccgtcggcgtcggcaggacagatgttggcgcagatctccagacacagcaacccgactcaaggtgccaccccgacttggaccccgactactcggtcaggattctcagcacagcaagtcgccacccaggcaactgctaaaacccgcaccagccagttcggcgtcggttccttccagaccccgagctccttctcaagcatgagcctgccaggggcacccaccgcatcccctggtgctgccgcgtacccgtcattgactaatcgcggctccaacttcgctccagaaaccggtcagactgccggacagtttcagactcggaccgccgagggagtgggagtctggccgcaatggcagggccagcagccacatcatcgctcgtcatcgtcggagcagcacgtgcagcagcctccggctcagcagcccggtcaacccgaagtgttccaagaaatgctgagcatgctgggggaccagtccaattcgtacaataacgaagaattcccagacctgaccatgttccctccattctccgag

SEQ ID NO: 26117 - DNA, 2367 bp, Artificial Sequence
  Description of Artificial Sequence: Synthetic coding sequence
atggctgctacgacagccaatcccgaaatgactagtgatgtcccatctctcggaccagctattgcgtccgggaattctggaccaggaatacaggggggaggggcaatagtgcagcgcgctatcaaacgacgacctgggctggattttgacgacgatggagaaggaaattctaaattcttaaggtgcgatgatgatcagatgtctaatgataaggaaagatttgcaagatctgatgatgaacagtcttccgcagataaggaaaggctggctcgggaaaatcattccgaaattgaaagacgaaggcggaacaaaatgacagcctatataacagaactttctgacatggttcctacatgctctgccttggcccggaaacctgacaaactcacgatcctgaggatggcagtgtctcatatgaaaagtcttcgggggacagggaatacgtctactgacgggtcttataaaccttctttcctcactgatcaggagcttaaacaccttatcctcgaagctgccgatgggttcctgtttatcgtttcctgcgaaacaggacgggtcgtgtatgtgtcagatagtgtgacacctgttttaaatcagccccagtccgaatggtttggatcgacactgtacgatcaggtacatcccgatgacgtggataaactaagggagcagttgtccacaagtgaaaatgcacttactgggagaatcctcgatctcaaaacggggactgtcaagaaggaaggacagcagtcgtcgatgcggatgtgcatgggatcacgtcgatctttcatctgccgcatgcgctgtgggtcgtcgtccgtggatcctgtgtctgtcaataggctctcatttgtgcgcaatagatgtcggaatggattaggaagtgtcaaagatggagaaccccacttcgtggtggtgcattgcacagggtatataaaagcatggccccccgctggggtctctctccctgatgatgatcccgaagccggacaaggaagtaagttttgtctcgtggcaatcggacggctccaggttacttcctcccctaactgcacagatatgtccaatgtttgtcagcccactgaattcatctctaggcataatatagagggaatctttacttttgtcgatcaccgatgtgtggctactgtgggataccagccacaggagctgctcggaaaaaacatcgttgagttttgccatcccgaagatcagcagctccttcgggattccttccagcaggtagtcaagctcaaagggcaggtgctgtctgtgatgtttcgatttcgatctaaaaatcaggaatggctctggatgcggacttcttcttttacttttcagaacccttattccgatgaaattgaatatatcatctgcactaacactaatgtaaaaaactcctcacaggaacctagaccaacacttagtaatactatccagcgacctcagctgggaccaacagccaatctgccactagaaatgggatctgggcagctagcgcctcggcagcagcagcagcagacagaacttgatatggtgcctgggcgcgatgggctcgcatcttataaccactcacaggttgtccagccagtgacgacaacagggcctgaacactcaaaaccactcgagaagagtgatgggctctttgctcaggatagggatccaagattctctgaaatataccataatataaatgccgatcagtctaaagggatctccagttccacagttcccgccactcagcagttgttctctcaggggaatacatttccccctacacccaggcctgccgaaaatttccgaaactctggacttgcccctcctgtgacaatcgtccagccatcagcgtctgccgggcagatgctcgcccagatatcacgacactccaatcccacacagggagctactcctacgtggactcccacaacaagatctgggttttcagcccagcaggtggctactcaggccacagcaaaaactcgaacttctcagttcggagttgggtctttccagacaccatcctcattctcctcaatgtcactccctggggctcccactgcctctcctggagctgctgcttatcccagtcttactaaccgggggtctaattttgctcctgaaacagggcagacagctggacagttccagactcgcacggctgagggggtgggagtgtggccccagtggcaagggcagcagcctcatcatagatcctcctcatccgaacagcacgttcaacagccacctgcccagcagcccgggcagccagaggtgttccaggaaatgctgtccatgcttggagatcagtccaattcctataacaacgaagaattccccgatctgactatgttcccccccttttctgaa

SEQ ID NO: 26118 - DNA, 2367 bp, Artificial Sequence
  Description of Artificial Sequence: Synthetic coding sequence
atggcagcaacgaccgccaatcccgagatgacatcagacgtcccgagcctgggccccgcaatcgcctcaggcaacagcgggccgggcattcagggcggcggagcaatcgtgcaaagggctataaaaaggaggccggggctggatttcgacgatgacggggaaggtaactctaaatttcttcggtgcgacgatgatcagatgtcaaacgataaagagaggtttgcacgctccgatgatgagcagtcctcagctgataaagaacggctggcacgggagaatcacagtgagatagagcggagaagacgcaacaagatgacagcttacattacagagctgagcgacatggtgcccacctgtagtgctctggcgaggaaacccgacaagctgaccatcctgagaatggccgtttcccacatgaagagcctccgaggtacggggaacacttccacggacggctcttacaaaccaagcttcctgactgaccaggagctcaagcacctgatcctggaagcggccgatggctttctcttcattgtaagctgtgaaaccggaagggtggtgtacgtcagcgattccgtcaccccggtcttgaatcagccccagagtgaatggttcggtagcaccctgtacgaccaggtccaccccgatgacgtagataagctgagggagcagctgtcaaccagcgagaatgcacttacaggcagaattcttgatctcaaaacaggcaccgtgaaaaaggagggacagcaaagttctatgcggatgtgcatgggctcacggaggtccttcatttgtagaatgaggtgcggctccagctctgttgatcccgtgagtgtgaaccggctgtcttttgtccgcaacagatgtagaaatggactcggcagcgtcaaagatggtgagccacactttgtggtcgttcactgtaccggctacatcaaggcttggccacccgccggggtgagtttgcccgatgacgatccagaagccggacagggtagtaaattctgtcttgtggccatcggccgcctgcaggtgacctcttcacctaactgtacggacatgtccaatgtgtgtcaacccactgaatttatttctaggcataatatcgagggaatctttacatttgtggaccatagatgtgtcgctaccgtgggataccagcctcaagagcttctgggaaaaaatatcgtagagttttgccaccctgaagaccagcaactgctgagagacagtttccagcaggtagtcaagctgaaaggacaggtgcttagcgtcatgtttcggtttagatcaaaaaaccaggaatggctgtggatgcggacttcatcttttaccttccagaatccatacagcgatgagatcgagtatattatttgcactaatactaacgtcaagaattcctcccaggaaccccggccaactctgagcaatactattcagcgaccacagctgggtcccaccgccaatctgcccctggagatgggctctggtcagctcgctcccaggcagcagcagcagcagacggaactggacatggtgccgggacgggatggcctggcgagttataatcactctcaggtggtccagccggtaaccacgacaggccccgagcactccaaacctctcgaaaaatcagacgggctgtttgcgcaggatcgggaccctaggttctctgagatttaccacaacatcaacgcggatcagtccaagggaataagctcttccactgtccccgccacgcagcagctgttcagccagggaaacacatttccacccacaccccgaccagcagaaaactttcggaatagcgggctcgcccctcctgttacaattgtacaacccagtgcttcagccggacagatgctggcccaaatctcccggcactccaatccgacacagggagcgactcctacttggacgcctactacacggagcggttttagtgcccagcaggtggcgacccaagccaccgctaaaacgaggaccagccagtttggggtagggtccttccaaaccccatccagtttctcctctatgagcctgccaggcgcacctaccgccagcccaggagccgccgcctatccctctctcacaaaccggggatctaatttcgcacccgaaacaggtcagactgcaggccagtttcagacgcgcactgccgagggtgtcggcgtctggccccagtggcaggggcagcagcctcaccaccggtcctcctcttccgagcagcacgtgcaacaacctccagcccaacaacctggacagccggaggtcttccaggagatgctgtccatgctgggagatcagagcaacagctataacaatgaagagtttccagaccttaccatgtttccgccgttctcagaa

SEQ ID NO: 26119 - DNA, 2367 bp, Artificial Sequence
  Description of Artificial Sequence: Synthetic coding sequence
atggccgctacaactgcgaaccccgaaatgacttccgatgtaccatcactcggacccgcaatcgcttcagggaattccggacctgggattcagggagggggagctatcgtacagcgagctattaaacggcggcccgggctcgattttgatgatgatggagaaggaaactccaaattcctacggtgcgatgacgatcagatgagtaatgataaagagcgcttcgctagatctgatgatgaacagtcctctgctgataaagagagattagcacgagagaatcattccgagatagaacggcggcgacgaaacaaaatgacagcctatatcactgaactgtctgacatggtgccaacatgttctgccctagctaggaaacctgataaactgacaatccttagaatggccgtctcacacatgaagtcactgaggggaactgggaacacatctactgatggatcttacaaacccagtttcctgacggaccaggaactcaagcatttgatactggaagcagctgatgggtttctgttcatcgtatcctgtgaaactggacgagtggtctatgtttctgattcagtgactccagtgctcaaccaacctcagtctgaatggtttggatctacactgtatgatcaagtgcaccccgatgatgtcgacaaactccgggaacagcttagtacgagtgaaaacgctttgactggacggatcctagatcttaaaactgggacagtcaaaaaagaaggacagcagtcttccatgcgtatgtgtatggggtctcgcaggtccttcatttgcagaatgaggtgcggatcatcttctgtcgatccagtctccgttaaccgcctctccttcgtgagaaataggtgtagaaatgggctgggatcagtgaaggatggggaaccccactttgttgtggtgcattgcacagggtacatcaaagcttggccaccagccggggtctctcttccagatgatgatcccgaagcaggacagggatcaaaattctgtcttgtcgcaatagggcggctgcaggtgacatcttctccaaactgcactgacatgtccaatgtgtgtcagcccacagaatttatctcccgtcataatattgagggaatttttactttcgtggatcaccggtgcgtcgcgactgttggataccagccacaggaactgttggggaaaaatattgtggaattttgtcatccagaagatcaacagttgctgagggattccttccagcaggtggtgaaattgaaagggcaagttctgtctgtgatgttccgcttccggtccaaaaatcaagagtggctttggatgcgcacatcttcattcacttttcagaatccctatagtgatgaaatagaatatattatttgcacaaacacaaatgtgaaaaacagttcccaggaaccaaggcccactctctccaatacaatccagagaccccagctcggacccacagctaatctcccactcgaaatgggatccggacagctcgctccaaggcagcagcagcaacagacagaactcgatatggtccctggaagggatggactcgcatcttacaatcatagtcaggtagtgcagcctgtcactacaactggacctgagcacagtaaaccattggaaaaaagtgatggactattcgcacaggaccgcgatccaaggttttctgaaatttatcataacattaatgcagaccagtcaaaggggatctctagttctactgttcctgctacacagcagctcttctctcaggggaatacattccctcctacgccacgacccgctgaaaatttcagaaattccgggcttgcacctcccgtgacaatagtgcagccctccgcatctgcagggcagatgctcgcccagatatctaggcattccaaccccactcagggagccacacctacttggactcctacaactcggtccggattctcagctcagcaggtcgctactcaagccacagctaagacacgcacatcacaatttggagtgggatcttttcagactcctagtagtttttccagtatgtctctacccggagctcccactgcatccccaggagcagcagcctacccttctctgacaaataggggatctaattttgcccctgaaactgggcagactgccggacagttccagacgaggacagctgagggggtcggggtgtggccacagtggcagggacaacagcctcatcacaggagttcttctagtgaacagcatgttcagcagccccccgctcaacaacctggacagcccgaagtcttccaggaaatgctatccatgctaggggaccaatcaaatagttataataatgaagaatttcctgatctaactatgtttccacccttctctgaa

SEQ ID NO: 26120 - DNA, 2367 bp, Artificial Sequence
  Description of Artificial Sequence: Synthetic coding sequence
atggctgctactaccgcaaaccccgaaatgacaagcgacgtgccttccctaggaccagctatcgcatccggcaactcaggcccgggcatccagggtggaggagctattgtgcagagggctattaagaggcgcccaggcctggatttcgatgacgacggagagggcaacagtaagttccttcgctgcgatgatgatcagatgagcaatgacaaggagaggttcgctcggagcgacgacgaacaatccagcgccgataaggaacgcctggcaagagagaaccacagcgaaatagaacgaaggcggagaaacaagatgaccgcctatatcaccgagttatccgatatggtgcccacatgcagcgctctggcccgcaagcctgataaactcacaatcctgagaatggcagtaagtcacatgaagagcctcaggggaactggaaatactagcacagacggaagttataagccaagttttctcacggatcaagagttgaagcacctgattctggaggcagctgatgggtttcttttcatcgtgagctgcgaaacagggagggtggtctacgtaagtgacagcgtgacaccggtgcttaaccaacctcaatctgagtggttcggaagtaccctgtacgatcaggtgcatccagacgacgtggacaaactgcgggagcagctgtctacaagtgaaaatgcactcaccgggcgcatactggacctgaagactggaacagtgaaaaaggaaggacagcagtcttctatgcgcatgtgcatgggttctagaaggagctttatctgtagaatgcggtgcggcagcagttcagtggatcccgtctctgttaacagactctccttcgtcagaaaccggtgtagaaacggattgggaagtgttaaggatggtgagcctcatttcgtagtggtgcactgcaccggatacatcaaagcttggccccctgcgggcgtgtcactgcctgatgacgatcctgaagccggccaaggcagcaaattctgcctggtggccatcggacgcttgcaagtgactagcagccccaactgcaccgatatgtccaacgtttgccagcccaccgaatttatcagccggcataacattgaaggcatttttacattcgtggatcatagatgtgtcgccaccgtgggctaccagccacaggaacttcttgggaaaaacatcgtggagttttgtcacccagaagaccagcagctgctgcgcgatagctttcaacaagttgtcaagctgaaagggcaggtactcagcgtcatgttcaggtttcggagtaagaaccaggagtggctgtggatgagaaccagttcctttacttttcagaacccatattcagacgagatagaatatatcatttgcaccaataccaatgtgaaaaacagtagtcaagagcctcgacccacactaagcaacaccatccaaaggccccaactggggccaaccgccaacctgcctcttgaaatgggtagcggccagctcgcacctaggcagcagcaacagcagaccgaactagacatggttccaggacgggatgggttggccagctacaatcacagtcaggtggtgcaacccgttaccacaaccggaccagaacatagcaagcctttggaaaagagtgatggcctctttgctcaagatagggaccctagattcagtgaaatctatcataacatcaacgccgaccaatccaaggggattagtagttctaccgttcccgctacccaacaactgttcagtcagggaaatacctttccccccacacccagaccagctgaaaatttccgcaacagcggcctggctccccctgtgaccattgtgcaacctagcgctagcgctggccaaatgcttgctcaaatctctaggcattctaacccaacccagggagcaacacctacttggacccccaccaccagaagtggcttcagcgctcagcaggttgcaacccaggcgaccgctaaaactcggaccagccagttcggcgtgggtagcttccagacacctagcagtttctcctcaatgtcgctgcctggagcaccaaccgcttcacccggagccgctgcttacccttcattaaccaacaggggaagcaacttcgccccggaaactgggcagactgccggacagtttcagactcggacagccgaaggggtgggggtctggccacaatggcagggtcaacaaccacaccaccgctccagctcctctgaacagcacgtgcagcaaccgccagcacagcaacccggccaacctgaggtttttcaagaaatgctgtctatgctcggagatcagtctaacagctacaacaacgaggagttcccagacctgaccatgttccctcccttttctgaa

SEQ ID NO: 26121 - DNA, 2367 bp, Artificial Sequence
  Description of Artificial Sequence: Synthetic coding sequence
atggccgcaacgacggccaatcccgaaatgacttccgatgttcctagtctgggacctgctatagcctcaggtaattcaggcccaggaatccaaggtgggggtgccattgtgcagagagccatcaagcgtagaccgggtcttgatttcgatgacgatggtgagggcaatagtaaattcctcaggtgcgatgatgatcagatgtcaaatgataaggaacgattcgccaggtcagatgatgaacagtcctccgcggataaggagcggctggccagggagaaccactcggagattgaacggcgtcgcaggaacaaaatgaccgcatacatcactgaactatccgatatggttcccacctgttcggcgttggcccggaagccagataagcttacaatactccgcatggccgtctcccacatgaagagcttacgcgggacaggaaatacctcaaccgacgggagctacaagcctagcttcctcactgaccaggaattgaagcacctaatcctagaggccgccgatgggttcttgtttatcgtatcctgcgagacgggaagagtggtgtacgtgtcggattcggtgacgcccgtcttgaatcagccccagtctgaatggttcggcagcacgctgtacgatcaagtgcacccagacgacgtggataaactgcgggagcagctgagcacttccgaaaatgccctgacgggtcgcatcttggacttgaaaacagggacggtaaaaaaggagggccagcaaagcagcatgcggatgtgcatgggatccaggcgttcctttatttgccggatgcggtgtgggagctccagcgtggatccggtgagtgttaatagactatctttcgtacggaatcgatgccgaaatggactgggctccgtaaaggacggagagccccactttgtggtggttcattgcacgggctacattaaagcttggcctccagccggagtgtcactacctgacgatgatccggaagccggtcaggggtccaagttctgcttggtcgcgattgggcgcctccaggtaacaagcagtccgaactgcacagacatgtcaaacgtgtgccagcccacagaatttatttcccggcacaatatcgagggcatctttaccttcgtcgatcacagatgtgtcgccaccgtcggctatcagccccaggagttgctggggaaaaatatcgtcgaattttgccaccccgaggatcaacaacttctccgtgatagcttccaacaggtggtaaagttaaaaggccaggttctttccgtcatgttccggttccggagtaaaaaccaggagtggctgtggatgcgcacatcatcctttacttttcagaacccctactccgatgaaatcgaatatatcatctgtactaataccaatgttaaaaactcatcacaggagcccagacccacactgtcaaatacaatacagagacctcagttgggccccaccgccaatcttcccctcgaaatgggctctggacaacttgctccacgacagcagcagcagcagacagagcttgatatggtgcccggaagggacgggctcgcctcctacaaccacagccaggtcgtgcaaccagtgacaacaaccggacccgagcactcaaagccccttgaaaaatcagatggcctgttcgcacaggaccgggacccacgattttctgaaatttaccacaatataaatgccgaccaatcaaaagggatttcctcttctaccgttcctgcaacccagcagttgttttcacaaggcaacacatttccccccacccctcggccagcagagaacttcagaaatagcggtctggcaccccccgtgacgatcgtgcagccatccgcatctgccgggcaaatgctggctcagatttcccggcattccaatcccacccagggtgctacccctacctggactccaactacaaggtccggatttagcgctcaacaggtggctactcaggctactgccaaaacgaggacgagccagttcggtgttggttcgttccaaacacccagctcattctcctccatgtccctgccgggcgcccctacagcaagcccaggtgcagccgcctatccctcattaaccaacaggggcagtaacttcgcacccgaaactgggcagacagccggtcagttccagacaaggaccgctgagggtgtcggagtctggccccagtggcaaggccagcagccgcaccaccgctcatcatctagtgagcagcatgtgcaacagcccccggcacagcagcctgggcagccggaagtattccaagagatgctctcgatgctcggggaccagtctaactcatacaataacgaggagtttccggacctcactatgttcccgcccttctctgag

SEQ ID NO: 26122 - DNA, 2367 bp, Artificial Sequence
  Description of Artificial Sequence: Synthetic coding sequence
atggccgcaaccaccgccaatccagaaatgacgtccgacgtacctagcctggggcccgccattgcatccgggaacagcggtcctggcatccagggtggcggcgccatcgtgcagcgggcaatcaagagacgacctggactggactttgacgatgacggcgaaggcaattccaaattcctgcggtgcgacgacgatcagatgtctaatgacaaggagcgcttcgcccggtctgacgacgaacaatcatccgccgataaggagcggctcgcccgggagaaccacagcgagatcgagagacggaggcggaataagatgactgcctacatcactgagctcagcgatatggtgcctacatgtagcgccttggcgagaaagcctgacaaattgaccatcctgagaatggccgtctcacatatgaaaagcctcagagggacaggcaacacctctactgacggctcctataagcccagtttcttgacggatcaggagttgaagcatctgattctggaggccgcagacggatttctcttcatcgtctcttgcgagacaggccgggttgtctacgtatctgactccgtcactccggtgctgaatcagccccaatctgagtggtttggcagtaccctttatgatcaggtgcatcctgacgacgtcgacaaacttagggagcagcttagtacgagtgagaacgctctgactggtagaatcctggatctgaaaaccggcacggtaaagaaagagggccagcagagttccatgcgcatgtgtatgggcagccgcagaagcttcatatgccgcatgaggtgtgggtcctcatccgttgaccccgtgagcgtgaaccgcctgagctttgtgcggaaccggtgtagaaacggtctggggtcagtcaaggacggcgagccacactttgtggtggtgcactgcacaggttacataaaggcctggcctcctgccggagtgtcactgcccgatgatgaccccgaagcgggccagggctccaaattctgtctggttgcaataggtaggctgcaggtgacttcttcccctaactgcacagatatgagcaatgtatgccagccgacagagttcatatctcgccacaacatcgagggaatcttcacattcgtggaccacaggtgtgtcgcgaccgtgggttaccagcctcaggagctgctcgggaagaatattgtcgagttttgccacccggaagatcaacagttgctcagggactctttccaacaggttgtaaagctcaaaggacaggtcctttctgtgatgttccggttccgatccaagaatcaagaatggctttggatgaggaccagctcctttacattccaaaacccctattcagatgagatcgaatatataatttgtaccaataccaatgtgaagaactcatcacaagaaccacggcccaccctgagtaataccattcagagaccgcaactcgggccaacggcaaacttgcctcttgaaatgggcagcggacagctggcacctaggcaacagcagcagcagactgagctcgatatggtgccaggacgagacggcctcgccagttataatcattctcaggtggtgcagcccgtaactaccacagggcctgagcactccaaacccttggaaaagagcgatggacttttcgcccaggaccgagacccacgattctctgagatttatcacaacattaatgctgaccagtctaaagggatcagctctagcaccgtgcctgccacccagcagctgttctcccaaggcaatacatttcctccgaccccaagacccgcggagaattttaggaattctgggctggccccccccgtgaccatagtgcaaccgtccgcgtccgctggacagatgctggcacagatcagccggcactcaaatcctacccagggggccacccctacctggacaccaacaacccgaagtgggttcagcgcccagcaagtcgcaacacaggcaacagcaaagactcgaactagtcagttcggggttgggtcatttcaaaccccgagctcctttagctccatgagcttgccaggcgcgccaacagcaagtccaggagcagcggcctacccgtctcttactaaccgcggatcaaattttgctccagaaactggacagactgccgggcagttccagacacgcacagctgaaggggtgggagtctggcctcaatggcagggccaacagccccatcatcggtcctccagttccgaacagcacgtacagcagcccccagcccagcagccaggacagcctgaggtctttcaggagatgctgagcatgctgggagaccagtccaactcatataataatgaggaattcccggacctgaccatgttccctccattcagcgaa

SEQ ID NO: 26123 - DNA, 2367 bp, Artificial Sequence
  Description of Artificial Sequence: Synthetic coding sequence
atggcggccactaccgcgaaccccgaaatgaccagtgatgtaccgagcctgggtcccgccattgcgtcgggaaacagcggcccgggcattcagggggggggcgcgattgtccagcgcgcaattaaacgaagacccggactggacttcgatgacgacggcgaggggaatagcaaatttctccggtgtgatgatgaccaaatgagcaacgataaagagcggtttgcgagaagcgacgatgagcagtccagcgccgacaaagagagactagcccgggagaatcatagcgaaattgagagacgccgtcgcaacaaaatgactgcctatatcactgaactgagtgacatggtaccaacatgttccgctttagcccgcaaaccggacaagctgactatcctcagaatggctgtgagtcatatgaagtcactgaggggaactggaaatacttctacggacgggagctacaagccctcatttctgaccgaccaggaactcaagcaccttatcttagaggctgccgacgggtttttattcattgtaagttgcgaaacaggaagagtcgtatacgtctcggactcagtaacaccagtcctgaaccaacctcagagcgagtggtttggcagcacactctacgaccaagtgcatcctgatgatgtggataagttgcgggaacagctgtcaacttccgaaaatgcattaaccggtaggatcctggatcttaagacagggactgttaaaaaggaaggacagcaatcatccatgaggatgtgtatgggctcccgccgaagcttcatctgtcggatgagatgcgggtcgtccagcgtggaccctgtgagtgtcaaccgtctgtcatttgtcagaaatagatgtagaaatggcctgggttcagtgaaggatggagaaccgcacttcgtggtggtgcattgtacggggtacattaaggcgtggcctccagcaggcgtcagccttcccgatgacgaccctgaggcggggcaggggagtaagttctgcctagtggcaatcggtagactgcaggtaacatcctcccctaactgtacagatatgagcaacgtctgccaaccgacagaattcatctctaggcataatatcgaaggaatattcacctttgtggaccaccggtgcgtggcgacggtgggctaccagcctcaggaattactgggtaaaaacatcgtggaattctgccatcccgaagatcagcagttgttgagggattcattccagcaggtggtgaagttaaaagggcaggtcctgtctgtaatgttcagattcaggtctaagaaccaggagtggctgtggatgcggacttctagcttcacgttccagaacccttactctgacgagatagagtacataatttgcactaacaccaacgttaagaactcatctcaagaaccgagacctactctgtccaatacaattcagcgaccacagttggggcccacagcgaatctgccgttggagatggggtctggccagttggctccccgccagcagcagcaacagacagagctggacatggtacccgggcgcgatggtcttgcgagctataaccactcccaggttgtgcaacctgtgactacaactggacctgagcattctaaacctctggaaaaaagcgacgggctctttgcacaggatagagatccgcgcttctctgagatctatcacaacatcaatgccgatcagtctaaggggattagctcctctactgtgccagccacccagcagttgtttagtcagggaaacaccttcccccccacaccgcgtcctgcagaaaacttccgcaactcggggttagccccacccgtgactattgtgcagccaagtgccagcgctgggcagatgctggcccagatctctaggcatagtaaccccacacagggcgccacccctacctggactccgaccacgcgctccggcttctccgcgcagcaggtggccacccaagcaaccgccaagacccggacatctcagtttggagtaggaagcttccagacacccagttcattttcttccatgagcctgcctggcgcccccactgcctcacctggcgccgcagcatatccgtctctcactaacaggggtagcaactttgctcccgagacaggacagacagcaggccagtttcagacacgcacagcagagggagtgggggtttggccacagtggcaagggcaacagcctcaccatcgatcatcatcgagtgagcaacacgtccaacagccccccgcccagcagcccggccagcccgaagtgttccaagagatgctgagcatgcttggggatcagtctaattcttataataatgaagagtttcccgacctgactatgttccccccattctccgaa

SEQ ID NO: 26124 - DNA, 2367 bp, Artificial Sequence
  Description of Artificial Sequence: Synthetic coding sequence
atggccgctactactgcaaacccagagatgacttccgacgtgccttctttggggcccgcaatagcatctgggaactctgggcccgggatacagggggggggggccatagtacagagggctataaaaaggcggccaggactagattttgatgacgacggggaaggaaactccaaattccttaggtgcgacgatgatcagatgtctaacgataaagaacgatttgcccgatctgatgatgaacagtcgtccgctgacaaagagaggctggcacgggaaaatcattctgaaattgaaagacggaggaggaataaaatgacagcctacataactgaactttctgatatggtccccacatgttcagcactggcacggaaaccagataaactaactatactgcgaatggcagtgtctcacatgaaatcgttgcggggaacaggaaatacttccacagatggatcttacaagccctcctttctgactgatcaggaattgaaacacctcatcctggaagccgccgacggattcctctttatcgttagttgcgaaactggacgggtcgtatacgtctctgatagtgtcacacccgtcctgaatcagccacagtctgaatggttcgggtcaacactgtacgatcaagtacatcctgatgacgtggataaattaagagaacagctttccacatcggaaaacgccttgacagggcgcattctagatctgaaaacagggactgttaaaaaagaaggacagcagtctagtatgcggatgtgtatggggagtagacgctccttcatctgtaggatgcggtgcggatctagttcagtggatccagtgagtgtcaatagacttagtttcgtcagaaatcggtgcaggaacggactagggagtgttaaagatggagaaccacactttgttgtggtgcactgcactgggtatataaaagcatggccacctgctggagtatcactacctgatgatgatcctgaagcaggacaagggtccaaattctgtttggtggcgatcggacggctacaggtgacatcatcccctaactgtacagacatgtccaatgtatgtcaacctactgaatttatctctagacataacatagaaggaatcttcacatttgtggatcaccggtgtgttgcgactgtggggtatcaaccacaggaactccttggaaaaaacattgtggagttctgccacccggaggatcagcaattgcttagggatagtttccagcaggtggtgaaactcaaagggcaggtattgtccgtgatgttccggtttcgttctaaaaatcaggaatggctttggatgaggacttcatccttcacattccagaacccctattcggatgaaattgaatacataatctgcactaacactaacgtaaaaaactcctcccaggaaccaaggcctacactgtctaatacaatccagcgccctcagctcggacccacagcgaatctgccactggaaatggggtccggacagttagccccccggcagcagcagcagcaaactgaactagatatggttcccgggagggatggattggcctcctataatcattcacaggtggttcagcccgtaactactactgggcccgagcactctaagccactagaaaaatctgatgggctgttcgctcaggatcgagacccacggttttcagaaatataccacaacatcaatgccgaccagtctaaaggaatttccagttccacagttcccgcaacacagcagcttttcagtcagggaaacacatttccacccactcctcgacccgctgaaaatttccgcaacagtggacttgccccacctgtaactattgtacagccttccgcctccgctggacagatgctcgcacagatatccagacactcaaatcctacacagggggcaacacccacttggacacctacaactcgttccggattctccgcacagcaggtggccactcaggcaacagctaaaactaggacatctcagttcggagtcgggtccttccagactccatcttccttttcctctatgtcgctccccggggcacccactgcttcacctggggcagccgcttatccttcactcactaacaggggaagtaattttgcacctgaaactggacagactgctgggcagtttcagacacgaactgcagaaggagtgggagtgtggcctcagtggcaggggcagcaaccccaccaccggtcgtcttcatctgaacagcacgtgcagcagccccccgcccagcagcctggacagccagaagttttccaggaaatgctgtcaatgctcggagatcagtctaactcttataataacgaggaattcccagatctaacaatgttccccccatttagtgaa

SEQ ID NO: 26125 - DNA, 2367 bp, Artificial Sequence
  Description of Artificial Sequence: Synthetic coding sequence
atggcagcgactaccgccaaccctgaaatgacatctgatgtcccttcactcggacctgctatcgcctctggaaatagtggccctggaattcagggagggggagctatcgttcagcgagctatcaagagaaggcccgggctggacttcgacgatgacggagaaggcaattcaaaatttttgagatgcgatgacgatcagatgtccaacgacaaagaaagattcgccagaagcgatgatgaacaatccagcgcagataaagaaagactcgctagagagaatcatagcgagatcgagagacgcaggcgcaacaaaatgaccgcctacatcacggagctcagcgatatggtcccaacatgctcagccctcgccagaaaacctgacaagctgactattctccggatggctgtctctcacatgaaaagccttagaggaacagggaacacaagcaccgacggaagctataagccctcattcctaacagatcaagaacttaaacaccttatcctggaggccgccgatgggttcctgttcattgtgtcctgtgagactggaagagtcgtgtatgtgtcggatagcgttacacctgtgctaaaccagccacaaagcgagtggttcgggagcactctctacgaccaagtgcatcctgacgatgtggacaaactcagagaacaactttctacatccgagaatgcccttactggacggattctcgatctgaaaactggcactgtgaaaaaagagggccagcaaagtagcatgaggatgtgcatgggatctcggagatcttttatctgccgtatgcggtgcggaagttcatctgtggatccggtaagcgtgaacagactttccttcgtgagaaatagatgcagaaatggcctgggtagtgttaaagatggggaacctcactttgtagtggtgcactgcacaggatacatcaaagcttggcccccagctggcgtgagcctcccagatgacgatccggaggctggccaggggtctaaattttgcctcgttgccattggcaggttgcaggttacatcatctcctaactgcactgatatgtctaacgtctgccagcctacagagtttattagtcgtcataatatcgagggaattttcacattcgtagaccatcggtgcgtggccacagtgggctatcaacctcaggagctcctggggaaaaacatcgtggaattctgccacccggaggatcagcaacttctgcgagatagttttcagcaggtggtaaagctgaagggacaggtgctcagcgtaatgttccgatttagatccaagaaccaggagtggctgtggatgagaacatcgagttttacatttcagaacccctatagtgatgagattgagtacatcatttgtaccaacacgaacgtgaaaaacagcagccaggaacccaggccgaccctcagcaacaccatacagcggccacagctgggacctacagcaaacctgcctctcgagatgggaagtggacagctggcaccaaggcagcagcagcaacaaacagaattggatatggtgccaggacgggatggacttgcatcgtacaaccactcccaggtcgtgcaacccgtcaccaccaccgggcccgagcacagtaaacctctggaaaaaagtgacggactgtttgctcaggatcgagatcctcgcttcagcgagatctaccacaacataaatgccgatcagagcaaaggcattagctccagtactgtgcctgccacccagcaactgttttcccaaggaaacacattccccccaacccctcggccagcagaaaacttcagaaacagcggcttagctcctcctgtcaccattgtccagccaagtgcttccgcaggacagatgctggcccagatcagcaggcatagcaaccctacccagggcgcaacacctacatggacccccacaaccagaagcggtttttctgcacagcaggtggcaacccaagctactgccaagacccgcaccagccagttcggcgtgggctcatttcagacccccagcagcttctcatccatgagcctgcctggggctccaaccgcttctccaggggcggccgcttacccatcactgacaaaccgaggttcaaacttcgctccagagactggacagaccgctggccaattccagacccggaccgccgaaggcgtgggcgtgtggccacagtggcaaggacagcaacctcaccaccgcagtagcagcagcgagcaacacgttcagcaaccaccagcacagcagcctggccaaccggaggtgtttcaggaaatgctcagcatgttgggtgaccagagcaacagctacaacaacgaagaattccccgatcttacgatgttcccccccttctctgag

SEQ ID NO: 26126 - DNA, 2367 bp, Artificial Sequence
  Description of Artificial Sequence: Synthetic coding sequence
atggccgctacgacagcgaaccctgaaatgacgagtgatgtcccctctctcggtccagccatcgcctccgggaattcagggccgggaatccagggaggaggcgctattgtccagcgggccataaagaggcgcccggggctcgacttcgatgatgacggagagggaaactcaaagttcctgcgctgtgatgacgaccaaatgtctaatgataaggaacggttcgcgcggagcgacgacgaacagagttccgccgacaaagagagattggcgagagaaaaccacagtgagatcgagcgccggcgccgcaacaaaatgactgcttatataaccgaactgagtgatatggtgcctacctgctccgcactagctcgtaagcccgataagcttaccattctcaggatggcagtcagccatatgaagtctctcagggggaccggcaatacttctactgacggcagttataagccttcctttctgacagatcaggagctcaagcacctgattctcgaggccgccgacgggttcctgtttattgtatcttgtgaaaccggccgcgtggtctacgtaagcgatagcgttacgcctgtgctgaaccaaccgcaatcagaatggtttggctccacattatatgaccaggtccacccagatgatgtggataagctgagggagcaactgtccacatccgagaatgccctgaccgggagaatcctggatctcaagacaggaaccgtgaaaaaagaaggtcagcagtcatccatgagaatgtgtatgggaagcaggcggtccttcatctgtcggatgcggtgtggcagcagctcagtggaccctgtgtccgtaaacaggcttagctttgtacggaaccggtgccggaatggtctgggatcagtgaaggatggtgagcctcatttcgtcgtggttcactgcaccggctacataaaagcgtggccgcccgctggggtgagtctgccggatgacgacccagaggccggacagggctctaagttctgcctggtggcaatcggtcgcttgcaagtgacatcctcacccaactgtacggacatgagcaatgtgtgtcagcccacggaattcatcagcagacacaatattgaaggcatatttacattcgtggatcacagatgcgtagccaccgttgggtaccagcctcaggaactgctgggaaagaacatcgttgagttctgtcacccggaggaccagcagctcctaagggactcattccaacaggtggttaagctgaagggtcaggtcctgtcggtgatgtttagattcagatccaaaaatcaggagtggttgtggatgcgtacctcatctttcacctttcagaatccttactccgacgagatcgaatacatcatctgcactaacaccaatgtcaagaatagcagccaggagcctcgtccaaccttaagcaatacaatacaacgaccccaactgggtcctacggcaaatttaccactcgagatgggtagtggacagctagccccccggcagcagcaacagcagaccgagcttgacatggtgcctggaagggatggcctggccagctataaccactcccaagtggttcagcccgtgacaaccaccggaccagaacattccaagcccctagagaagtcagacgggctattcgcgcaggatcgtgaccctagattctccgagatctaccacaatataaatgcagaccagagtaagggaatctcatcctccaccgtgccagccactcaacagctgttttcccagggcaacacattccctcccacacctcgacccgccgaaaatttccgtaacagtggccttgctcccccagtcaccatcgttcagccgtctgcctccgccggccagatgctcgctcaaatttcacgtcacagtaatcctactcagggcgccacccctacgtggacccccactacccgctcgggtttctccgctcaacaggtcgctactcaggcgaccgctaaaacgcgaacttcacagttcggagtgggaagctttcagacacccagcagcttctcatccatgtctctccccggagcacccactgcaagccccggtgctgcagcctaccctagcttgacgaacagggggagcaactttgcacccgaaacaggccagaccgccggccagttccagactcgcacagccgaaggtgtgggcgtgtggccgcagtggcagggacaacaacctcatcatcgcagctctagtagcgaacagcatgtgcagcagccacccgcgcaacagccgggacagccagaggtgttccaagagatgctatcaatgctgggcgaccagagtaacagctacaacaatgaagagttcccagatctgactatgttcccaccattcagcgag

SEQ ID NO: 26127 - DNA, 2367 bp, Artificial Sequence
  Description of Artificial Sequence: Synthetic coding sequence
atggcagctacgaccgcaaaccctgaaatgacatctgacgtaccgagcttgggacccgctatcgcgtccgggaacagtgggcctggcatccagggtggcggtgcaatagtgcagcgcgcgatcaagagacggccaggtctagacttcgacgacgacggagaagggaactccaagttcctccggtgcgatgatgaccagatgtctaacgataaggagagattcgcccgctctgacgacgaacagtccagcgctgacaaggaaaggctagcaagggaaaaccactcagagattgaaaggaggcgccgcaacaagatgaccgcctatatcacggagctcagcgacatggtgcccacctgctctgcactggcgaggaaaccagataagctgaccattctgcggatggccgtctcacacatgaagtcactgcggggaacagggaacacctccacagatggttcatacaagccatcattcctaaccgatcaggagctcaagcacctgatcctggaagccgccgatgggttcctcttcatagtgagttgcgagacagggcgggtggtttatgtgagtgatagcgtgacccctgtgcttaaccaaccccagagcgagtggttcgggtccaccttgtacgaccaggtgcaccctgatgacgtcgataagttacgggagcagctgtcaacttctgagaatgctctgaccggccggattctggatttgaaaacaggcaccgtgaaaaaagagggccagcagagcagcatgcgcatgtgtatgggctccagacggtctttcatctgcaggatgagatgcggctcatcttccgtggatcctgtgagcgtcaacaggctttcttttgtacgtaatcgctgtcgcaacggcttgggaagcgtgaaggacggggaaccacactttgtggtcgtgcactgtaccggctacatcaaagcctggccacccgcaggcgtgtccttgccagatgacgatccggaggcgggtcaggggagtaagttttgtttggtcgccatcggccgactccaggtcactagtagcccgaattgtaccgacatgagcaatgtgtgccagccaacagagtttattagtaggcacaatattgaaggaatcttcacgttcgtcgaccacaggtgtgtggcgaccgtgggataccagcctcaggaactgctgggaaagaacatcgtcgaattttgtcaccccgaagaccagcagttactgcgagacagctttcagcaagtggtcaagctgaagggacaggtgctgagcgtcatgtttaggttccgcagtaagaatcaagagtggctttggatgcgtacctcttcctttacatttcagaatccgtacagtgacgaaatagagtacattatttgtacgaacaccaacgttaagaattcttctcaggagcctaggcctaccctctccaatactattcagagaccccagctggggcccacagcgaatctgcccctggagatgggctccggacagctcgcccctagacaacagcagcagcagactgagcttgacatggtacctggtcgggacggattagccagctataaccattcacaggtggtgcagccggtcactaccacagggccagagcattccaagccactggaaaaaagcgacggcctattcgcccaggaccgggaccctagattcagcgagatctatcacaatattaacgctgatcaatccaaggggatcagctcaagtaccgtacccgcaacgcagcagttattttcacaaggcaacaccttcccgccaacacctcgcccagccgagaacttcagaaactcaggactcgcaccaccagtcaccattgtgcagccatccgcctccgccgggcagatgctggcccagatctccagacattcaaaccctacccagggagcgactccaacctggactcccactaccaggtctggcttctctgcacagcaggtagccactcaggctactgctaaaaccagaactagccagttcggggttggatcctttcagaccccctctagcttcagcagcatgtctctgcccggtgcccccactgccagcccaggggccgctgcgtacccatctctgactaatcggggaagtaatttcgcaccagaaaccgggcagaccgcgggccaattccagactcgcacagctgaaggagtcggcgtttggccccagtggcaaggccagcaaccgcatcacagatcttccagctctgagcagcacgtccaacaacccccagcccagcaaccaggacagcccgaagtttttcaggagatgctgagtatgctcggagaccagagcaattcctacaataatgaggagttccccgacctgactatgtttccacccttctctgaa

SEQ ID NO: 26128 - DNA, 2367 bp, Artificial Sequence
  Description of Artificial Sequence: Synthetic coding sequence
atggccgctacaactgcaaatcctgagatgacaagcgacgtcccatccctgggacctgctatcgccagtggaaatagcggtccaggaattcagggggggggagccattgtgcagcgggcaattaagagacgccccggtctggatttcgacgacgacggcgaagggaactcaaaattccttaggtgcgacgatgaccagatgagtaatgataaggagagatttgccaggtctgatgatgaacagtcttccgccgacaaggagcggttggctagggagaaccacagcgagattgaacgccggaggcgcaacaaaatgacagcgtacataacggagctttctgacatggtcccaacgtgtagcgccctggcccgcaaacccgataagctgacaatcctgcggatggctgtgtcacatatgaaatcactcagaggaactggaaacacctctacagacggctcatacaaaccatccttcctgaccgatcaggagctcaaacatctcatcctcgaggctgctgatgggtttctttttatcgtctcctgcgagacgggccgcgtagtgtacgtctctgattctgtgactccagtgctgaaccagccccagagtgaatggtttgggtcaactctgtatgaccaagtgcaccctgacgacgtggataaactgagggagcagctgtcaacatccgagaatgcgctgaccgggagaatcctcgacctgaagaccggcactgtgaaaaaggagggccaacaatcctcaatgcgcatgtgcatgggctctcgacgctcatttatctgcaggatgcgatgtggcagcagttcagtagaccccgtgtctgtgaaccgccttagctttgtgaggaaccgctgtaggaacggcctggggagtgtcaaggacggagaaccacacttcgtggtcgtgcactgtactgggtacatcaaagcctggcctcccgcaggtgtgagcctgccagatgacgaccctgaagcggggcaagggagcaagttctgcctggtggccataggccggcttcaggtgacctcctcacccaattgcacagacatgagtaatgtgtgccagccaactgaattcattagcagacataatatcgagggaatcttcactttcgtggatcacagatgcgtggcgactgtcggctaccagccccaggaactgcttggtaagaacatcgtggagttctgtcaccccgaggatcagcagctgctccgggattccttccaacaggtggttaagctgaagggtcaggtgctgagtgtgatgttcaggttccgcagtaagaatcaagaatggctctggatgcggacaagcagtttcacctttcaaaatccctattccgatgagatcgaatacatcatctgcaccaatacgaacgtcaagaattcttctcaggagcctcggccgacactgagcaatacgatccagcggccccaattgggtcccactgctaaccttccgttggaaatgggttctggccagctcgctcctaggcagcagcagcagcagacggagctcgacatggtgcctggccgggacggcctcgcaagttacaatcacagccaggtggtacagccggttactacaaccgggcctgagcattctaaacccctggaaaaaagtgacggtttgttcgcccaggacagagacccacggtttagcgagatctaccacaatatcaacgctgatcagagcaaaggaatcagttcatcaacggtgcctgccacccagcagctgttctctcagggtaatacattcccaccgacaccccgacccgccgaaaattttcgaaatagcggactggcaccccccgtcacaatcgttcagccttccgcaagtgctggacaaatgctggcccagatcagcaggcactctaatccaacccagggggccacccccacctggacccctacaactcggagcgggttttctgctcaacaggttgctacacaagcaactgccaaaaccagaacatcacagtttggcgtcggcagctttcaaacgccaagctcattctccagtatgagtctgcccggagcccccacggcgtctcccggcgcagccgcttacccttccctcacgaatcggggttctaactttgctcctgagactggccaaaccgctggccagttccagacgagaaccgctgagggagttggcgtgtggccacagtggcagggccaacaacctcaccaccggtccagctctagcgagcagcacgtgcagcaacctcccgcccagcagccgggacagcccgaagtttttcaagaaatgctgtcaatgttgggagatcagtctaattcatacaacaatgaggagttcccggatttgactatgtttcctcccttctcagaa

SEQ ID NO: 26129 - DNA, 2367 bp, Artificial Sequence
  Description of Artificial Sequence: Synthetic coding sequence
atggctgccactactgctaatcccgaaatgacaagtgatgtgccatctctcggacccgccattgcgtccggaaactctggacccgggatccagggggggggagccattgtccagcgggctatcaaacggcggcccggattggatttcgatgatgatggggaaggaaactcaaaattccttaggtgcgatgatgatcagatgtcgaatgacaaagaacgattcgctaggtcagatgatgaacaaagtagtgccgataaagaacgactggcgcgggaaaatcattcagaaatcgaaagacggcgccggaacaaaatgacagcctacatcactgaactgtccgacatggtgcccacgtgttcagctcttgctaggaagccagataaacttacaatcctgagaatggcagtttcacatatgaaatcccttagaggaacagggaatacaagtacagatggatcctataaaccttccttcctcacagatcaggaactgaagcatctcatcctcgaagcagccgacggatttttatttattgtctcttgcgaaactggaagggtggtttatgtctctgattctgtgacaccagtcctgaaccagccacagtccgaatggtttgggagtacactatatgatcaggtccatcctgacgatgtcgataaactacgggagcagctcagtacaagtgagaacgccttgacagggcgcatactcgatttgaaaactggaactgtgaaaaaggaagggcagcagtcatccatgaggatgtgtatggggtctcggcggtcctttatctgtcggatgcgatgtggatcaagttccgtggatcctgtatccgtgaaccggctgtcgtttgtccggaataggtgtcggaacgggctagggtcagtgaaagatggggaaccccactttgtggtagtacattgcacaggatacattaaggcctggcctccagccggggtaagtctccctgatgatgaccctgaggcgggacagggatctaaattttgcttagtagcaatcggaaggctacaggtgacttcttctcctaattgcacagatatgtcaaacgtatgtcagcccacagaattcatatcccggcacaatattgaagggatatttacttttgtggatcatcgctgcgtggccactgttggatatcagcctcaggaattacttggaaaaaatattgtggaattctgccacccagaggatcagcagttactcagggatagtttccaacaggttgtgaaactcaaaggacaggttctctcagtaatgttccggttccgatcgaaaaaccaggaatggctctggatgagaacatcatcattcacatttcagaacccatattctgacgaaatcgaatacatcatatgtacaaatactaatgtgaaaaacagttctcaggaacctaggcctactctatctaacacaatacagagacctcagctggggcccacagccaacctccccctcgaaatgggatccgggcagttggccccaagacagcagcagcagcagactgagctggatatggtcccaggaagagatgggcttgcatcgtataatcactcccaggtggtacagcccgtgactacaactggacccgaacacagtaaacccctggaaaaatccgatggattgtttgctcaggatcgggatcccaggttttccgaaatatatcacaatataaatgcggatcagtccaagggaatatcatcatctacagtgcccgctactcagcagttgttttcccagggaaatacttttccccccacgccccgcccagctgaaaactttagaaattctgggctggctccaccagtgactatcgtgcaaccctctgctagtgctggacagatgctggctcagatatctagacattccaaccctacacagggagcaacacctacttggactcctactacgcggagtggattctctgcacagcaggtcgctacacaggccacagccaagactcgcacatctcagttcggagttgggagttttcagacaccaagttcattctcctctatgtccctacctggagcacctactgccagtcctggagccgctgcttatccatcgctcactaaccgggggtctaattttgctcccgaaactggacagacagccggacagtttcagactcgcactgctgaaggagtaggggtgtggccccagtggcagggacagcagcctcatcatcggtcaagtagttccgaacaacatgtacagcagcctcctgcccagcagcctgggcagccagaagtttttcaagaaatgttgagtatgctcggggatcagtcaaactcatacaacaatgaagaatttcccgatcttactatgtttcctccttttagtgaa

SEQ ID NO: 26130 - DNA, 2367 bp, Artificial Sequence
  Description of Artificial Sequence: Synthetic coding sequence
atggcagcaactactgcaaatcccgaaatgacctcggacgtcccgtcgttgggacccgccattgcttcgggcaactcgggaccaggaatacagggtggcggagcaatcgtgcaaagagcaatcaaacgtagacccggtcttgattttgacgatgatggagaaggaaactcgaagtttctgcggtgcgatgacgatcagatgtccaacgacaaggaaagatttgccaggagcgatgacgaacaatcctcggcagacaaggagaggcttgcacgcgaaaaccattcagagatcgaacgcagacgacggaacaagatgaccgcatacattaccgagcttagcgatatggtccctacttgtagcgcgctcgccaggaaaccagacaagctgacgatacttagaatggccgtgtcgcacatgaaatcactgagaggtacggggaacacttcaaccgatggaagctacaagccatcatttctcaccgaccaagaactcaagcatctgattttggaagcagcagatggtttcctcttcatagtgagctgcgaaactggacgagtcgtgtatgtgagcgattcggtcactccggtccttaatcaaccacaatcagaatggtttggatccactctctacgatcaagtgcatcccgacgacgtcgacaagcttagggagcaactgtcaacttccgagaacgccctcaccggaaggattctcgatctcaaaaccggtaccgtgaagaaagagggacagcagagctcgatgcgtatgtgtatgggctcgaggaggagctttatctgtcggatgagatgtggctcgtcctcggtggaccctgtgtcagtgaaccgcctttcgttcgttcgtaatcggtgtcggaatggtctggggtcggtcaaggatggagagccacactttgtggtggtccattgcaccggatacattaaggcttggcctccagccggtgtgtcgcttcccgatgatgacccggaagcagggcaggggtcgaagttctgcctggtcgcaattgggcgactgcaagtgacctcctctcccaattgtactgatatgtccaacgtgtgtcagcctactgaattcatctcgagacataacattgaagggattttcaccttcgtcgatcatcggtgtgtggcgaccgtcggataccagccacaagaactgctgggaaagaatatcgtcgaattctgtcatcccgaggatcaacagcttttgcgggattcctttcagcaagtcgtgaaattgaagggacaggtgctgtcagtgatgtttcgctttagatcgaaaaaccaagaatggctgtggatgagaacctcatcgtttactttccaaaacccctactccgatgaaattgagtacataatctgcaccaacacgaacgtgaagaactcctcccaagagcctcgtccaaccctgtctaacaccattcagcggcctcagcttggcccaactgcgaaccttccccttgaaatgggcagcggacaactcgcccctcgccagcagcaacaacaaaccgagctggatatggtgccaggccgagatggtcttgcgtcatacaatcacagccaggtggtgcaacccgtgaccactactgggcctgaacattccaagcctctcgaaaagtcggatgggctgtttgcacaagaccgtgaccctagattttcggaaatctaccacaacatcaatgccgaccagagcaaaggtattagctccagcactgtccctgcaacgcagcagctcttttcccaaggtaatacctttccgcctactccacgccctgctgagaacttccgcaattccggtctggcgccacctgttaccattgtgcaacctagcgcatccgctggacagatgcttgcacagatttcccgccattccaatccaactcaaggtgcaaccccgacttggactcccaccactagaagcggctttagcgcccaacaggtggcgactcaggccaccgcaaagacgagaaccagccaattcggcgtgggctcctttcaaaccccttcgtcattcagctcgatgtctctgcctggagcacctacggcttcaccgggagcagcagcatacccatcacttacgaaccgagggtccaactttgcccctgagactggtcagaccgctggacaatttcaaactagaaccgccgaaggtgttggtgtgtggccacaatggcagggacagcaacctcatcaccgctcatcctcgagcgaacaacacgttcagcaaccaccagcacaacagcctggacagccagaagtgttccaagagatgctgtccatgcttggcgatcagtccaatagctacaataacgaagaatttcctgatctgaccatgttccctccattttccgag

SEQ ID NO: 26131 - DNA, 2367 bp, Artificial Sequence
  Description of Artificial Sequence: Synthetic coding sequence
atggccgcaaccaccgcaaatccagaaatgactagcgacgtgccctcactgggtcccgccatcgcttccggaaactcaggtcccggcatccagggtggcggggccatcgtgcagagagccataaagcgccggccgggactggattttgacgatgacggagaggggaatagcaagttcttgcggtgtgatgacgaccagatgtccaatgataaggagcgctttgccagatctgatgatgagcagtcttctgctgacaaagagagattagcccgagaaaatcacagtgaaatagaacggcgtagacgtaacaaaatgacagcttacataaccgaactaagtgacatggttcccacatgctcggccctagcgagaaagccagataagctgacaatcctccggatggccgtttctcatatgaagagccttagagggacaggtaacactagtaccgatggttcttacaagccctctttcttgacggatcaggagctaaaacacctcatcttggaggctgcagacggtttcctctttattgtgtcttgcgagaccggccgggtcgtctacgtcagtgacagtgtgacccctgtgctgaatcagcctcagagcgaatggtttgggagtacactgtacgatcaagtccatcctgacgatgtggataagttgcgagaacagctttcgaccagcgaaaacgctttgaccgggaggatactggacctgaaaacaggcactgttaaaaaagagggccagcagagctcaatgagaatgtgcatgggctcccggcgtagcttcatatgtcggatgaggtgtgggtcttcttccgtcgaccctgtctccgttaaccgattaagcttcgtgagaaaccgctgcagaaacggcctcggctcggtcaaggacggtgagcctcactttgtcgtggtgcactgcacagggtacatcaaagcctggccccctgctggcgtgtctttgcccgatgatgatccagaggccggccagggtagtaagttttgcctggtcgcaattggccggctccaggtgacatcttccccaaactgcacagacatgagcaatgtgtgtcagccgacagaatttatctcacgacataacattgagggaatcttcacctttgtcgaccaccggtgtgtggccaccgttggctaccaaccgcaggaactgctggggaaaaatatcgtagagttttgtcatcctgaggaccagcaactccttcgtgattccttccagcaggttgtaaagctcaaggggcaggtgctttctgtcatgtttcgctttcgctcaaagaaccaggagtggctgtggatgcgcacaagttcgtttacctttcaaaatccttattccgacgaaattgagtacatcatatgcaccaatactaacgtgaagaactcctcccaggagcctaggcctacactgagtaacacaatacagcgccctcagttggggcccactgccaacctccccttggagatggggtctggccagttggcacccagacagcagcaacaacagactgagcttgacatggtacccggacgcgacgggctggcctcatataaccactctcaagttgtgcagccagtgaccaccacgggtcctgagcattcaaaaccattggagaagtcagatggtctgtttgcccaggatagggaccctcgcttctctgagatctatcacaacatcaatgccgaccagtctaaaggcatatcgagcagtacagtccccgccacgcaacaactcttctctcagggtaacacttttcctccgacacctcgccccgctgagaattttcgaaactctggattggccccaccagtcaccatcgtgcagccttctgcgtctgccggccagatgctagcccaaatctctcgccatagcaatcccacacagggcgccacccctacttggacccccaccacccggagcggattctccgcccaacaggtagctacgcaggcgacagcgaaaactaggaccagtcaatttggcgttgggagctttcagaccccctcatccttttcaagcatgagcctcccaggggcaccaactgcaagtcctggggcggccgcctacccttcacttactaatcgcggatcgaactttgcccctgaaacaggccagactgccggccagttccagacgagaaccgcggagggcgtgggcgtgtggcctcaatggcagggacagcagcctcatcacaggagctcctcttctgaacaacacgtccagcagccacctgcacagcagcccggccagccggaagtgttccaggaaatgctctccatgctcggagaccaatctaattcatacaacaacgaggaattcccagatctgactatgttcccacctttttctgaa

SEQ ID NO: 26132 - DNA, 2367 bp, Artificial Sequence
  Description of Artificial Sequence: Synthetic coding sequence
atggccgcgaccaccgctaaccccgaaatgacgagcgacgttcctagtctgggcccagctatagctagcggcaactcgggaccaggaattcagggaggaggcgccattgtgcagagagccataaagaggaggcctggcctcgactttgacgacgacggggagggtaactctaaatttctgcggtgcgacgacgaccaaatgtccaacgacaaagagcgcttcgcccgttccgatgacgagcaatcaagcgcagacaaagaacggcttgctagagagaaccatagcgagatcgagaggcgtcgacgcaacaagatgacggcttacattacagagctctcagacatggtccccacttgcagcgccctggccaggaagcctgacaagctgacgattttacggatggcagtgtcccatatgaagtctctgcgaggcactgggaacacgagcactgacggaagctataaacctagctttctgaccgaccaggaattgaaacatttaatcctggaggcggcagatgggttccttttcatagtgagctgcgagacgggtagggtggtctacgtatctgattcagttacccctgtacttaaccagccccagagcgaatggttcgggtccacgctgtatgaccaagtgcatcccgacgacgtggataaattgagggagcagctgagcacatcagagaacgcactgacagggagaatcctggatctgaagaccggaacggtcaaaaaggaagggcagcagtcttccatgcgcatgtgtatgggctctaggcgaagcttcatttgtcgtatgcggtgcggcagcagtagcgttgaccccgtgtcagtcaataggctctcatttgtcagaaatcgctgcagaaatgggctcgggagcgtaaaagatggcgaacctcattttgttgtggtacactgcaccggctacattaaggcctggccaccagccggagtgagtttgccggacgatgatccagaagcgggccaaggaagcaaattttgtctggtagcaattgggaggctgcaggtcacttcctccccaaattgcaccgacatgagcaacgtgtgtcagcccactgaattcattagtcggcataatatcgaaggcatcttcacgtttgtggatcataggtgcgtggcaaccgtgggttatcagccccaggaacttcttggcaagaacattgtggaattttgccacccagaggaccaacagctcctccgagatagtttccagcaagtggtcaagctgaaggggcaagtcctctccgtgatgttccggttccgatcaaagaaccaggagtggctgtggatgaggacatcgagcttcaccttccagaatccatactccgacgagatcgagtatattatttgtaccaacaccaatgtcaagaatagtagtcaggaaccaaggccaacgctgagtaatactatccagcggcctcagctcgggccgaccgccaacctgcccctggaaatgggcagcggacaactcgccccgagacaacagcaacagcaaacggagctggacatggtcccaggccgcgacggtttagccagctacaaccattcccaggtcgtccagcctgttaccaccactggaccggagcactccaagccactcgaaaagtcagatgggctattcgcacaggacagagatccccgcttctcggagatataccataacatcaatgctgatcagtccaaaggcatatcgagcagcaccgtgccggcgactcagcagctcttttcacaaggcaatacatttccgcccacccctcgccccgccgaaaacttccgcaacagcgggctggccccccccgttaccatagtgcagccatctgcctcagcaggtcagatgctcgctcagatttcacggcacagcaaccccacccagggcgcgactcccacctggacgcctaccaccaggagcggtttctccgcccagcaggtcgctacccaggcgactgccaagacccgcacaagccagtttggagtcggatcattccagacaccgagttcattttcatctatgtcactccccggcgcccccaccgcatctcccggggctgcagcatatccttccctcactaaccgtgggagtaactttgcaccagaaaccggccaaaccgcaggacagtttcagactcgcaccgccgagggggtcggcgtgtggccccagtggcaggggcagcaaccacaccaccgatctagttccagcgagcagcacgttcagcagccaccagcccaacaacccggtcagccagaggtcttccaggagatgttgagcatgctaggtgatcaatctaactcttataacaacgaggaattcccagatctgacaatgtttcctccattttcggag

SEQ ID NO: 26133 - DNA, 2367 bp, Artificial Sequence
  Description of Artificial Sequence: Synthetic coding sequence
atggccgcaactacagcaaaccctgaaatgacatccgatgtaccaagtttggggcctgccattgcatcagggaatagtggaccaggaatccaaggaggaggggcaatagtgcagagagctattaagcggcggccagggcttgattttgatgatgatggagaagggaactctaaattcctgcgctgtgatgatgatcagatgagtaatgataaagaacggtttgccaggtcagatgatgagcagtcatcagcggataaggaaagacttgcaagagaaaatcacagtgaaatcgaaaggagacgacgcaataaaatgactgcgtatataacagaactgagtgatatggtccctacttgttcagcactggcaagaaagcctgataagctaactatccttcgtatggcagtttcccatatgaaatcacttcgaggaacaggaaatacttctactgatgggtcttataaaccttctttccttacggatcaggagcttaaacacctcatactagaggccgccgatggattcttattcatagtctcttgtgagacaggacgcgtggtgtatgtatccgattccgtgactcctgtgcttaaccagccacagagtgaatggttcggatctacactttacgatcaggtgcatcctgacgatgtggacaaactacgagaacagctgtccacatccgaaaacgccctaacagggcggattctggatctcaaaactggaacagtgaaaaaagaagggcagcagagttccatgagaatgtgcatggggtctcgccgatcctttatttgcagaatgaggtgcggatcttcctcagtagacccagtttccgtgaaccgcctatcattcgtccgcaataggtgtcgaaacggattaggatccgtcaaagacggagaaccacacttcgtggtagttcactgtacagggtacataaaggcttggcctccagccggagtatccttgccagatgacgaccccgaagccggacagggaagtaagttttgtctcgtggcaatcgggagacttcaggtcactagttcacctaattgtactgatatgtccaacgtttgtcaacccacagaatttatatcacggcacaatatagaagggatattcacttttgttgatcatcggtgtgtggctactgtcggatatcagccccaggaactcttaggaaaaaacatagtagaattctgtcatcctgaagatcagcagctactcagggacagttttcagcaggttgtgaaactaaaaggacaggtcctatccgtaatgtttcgtttccgctcaaaaaaccaggaatggttgtggatgcgaacatcctccttcactttccaaaacccctacagtgatgaaattgagtatattatatgcacaaatacaaatgttaaaaattccagtcaggaacctcggcctactctatccaacactatacagagaccccagctcggacccactgccaatcttccacttgaaatgggatccggacagttagcccctcggcagcagcagcagcaaactgaactcgatatggtcccagggagagatgggttagcgtcctataaccattctcaggtcgtccagcctgttacaacgacagggccagaacattcaaagcctttagagaaatctgatgggcttttcgctcaggacagggatcccagattcagtgaaatctatcacaatataaatgccgatcagtctaagggaatctcctcatcaacagtgcccgccacacagcagctgttttctcaggggaacacatttcctccaacacctcggcctgccgaaaacttccggaactcagggctggcgccccccgtaactatcgtccagccttccgcctctgccggacagatgttggctcagatctctagacattccaaccctacacagggggccacgcctacatggacacctacaactcgatctgggttcagtgctcagcaggttgctacacaggccactgctaaaacgcgaacttcgcagttcggggttgggtctttccagactccaagttctttttcctcgatgtccctgcctggagctcccacagcctccccaggggcagcagcatacccttctctcacaaaccgggggtcaaatttcgcccccgaaacaggacagactgctggacagttccaaactcggacagccgaaggagtaggggtgtggccccagtggcagggacagcagccccatcatagatcatcctctagtgaacagcacgtacagcagcccccagcgcagcagcctgggcagcctgaagtgtttcaggaaatgttatctatgctcggagatcagagtaattcttataataacgaggagttccctgatcttactatgttccctccattttctgaa

SEQ ID NO: 26134 - DNA, 2367 bp, Artificial Sequence
  Description of Artificial Sequence: Synthetic coding sequence
atggcagccaccacggctaaccctgagatgacaagtgatgttccgagtctagggcccgcaattgctagcggcaacagcggtcccgggatccaggggggcggtgcgatagtccagcgggcgatcaaacggagaccgggtttggactttgacgacgacggggaaggcaactctaagtttttgcgctgtgacgacgaccagatgtccaatgacaaagagcgattcgccaggtcagatgacgaacagtcatctgcggacaaagagcggctggccagagagaatcatagtgagattgaaagacgccggagaaataagatgaccgcttacatcacagaattgtcagacatggtacctacgtgttcggcattggccagaaagcctgacaaattgaccattctgaggatggctgtctcacacatgaagagtttgcgaggcactgggaatacttcgactgacggcagttacaagcctagtttcctgaccgatcaggagctcaaacacctcatcctggaagctgctgatggatttctcttcattgtgtcctgtgaaacaggacgcgtggtctacgtgtctgactcagttaccccggtcctaaatcagccgcaatccgagtggtttggtagtacattgtatgaccaggtccatcccgatgatgtcgacaagctgagggaacaattgtccactagtgaaaacgcactaactggtcgcatccttgacttgaagaccggcaccgttaagaaggaagggcagcaatcttctatgcggatgtgcatgggctctcgccggagcttcatctgtaggatgcggtgcgggagcagttccgtagatccggtgagtgttaaccgtctgagtttcgttcgcaatcgatgccgcaacggcctgggatcagtgaaggacggggagcctcactttgtagttgtccactgtacagggtacattaaggcctggccccctgccggcgtgtctctcccggacgacgaccccgaagccggtcagggatcaaaattctgtctggttgcaatcggacgtttgcaagttacttcatcacctaactgcaccgacatgtcaaacgtttgccaacctactgaattcatttcgcgccacaatatcgaggggattttcacttttgtggaccatcgttgcgtcgcgactgtcggttaccagcctcaggagctgttgggtaagaatattgtcgagttctgccaccccgaggatcaacaactgctgagggattcgttccagcaggtggtcaagctgaagggacaggtgctctccgtcatgtttcgcttcagatctaagaaccaggaatggctgtggatgaggactagctccttcacctttcaaaatccttacagtgacgaaattgaatacattatctgcactaataccaatgttaaaaattccagtcaggaacctcggcccacattatctaacacaatccagcggccccagctaggccccacagctaacctgcctctggagatgggaagtgggcaattggcacccaggcagcaacaacagcagactgagctcgatatggtgcccggaagagatgggcttgcaagctataaccactcccaggtcgttcagcccgtcaccacaactggtccagagcactccaaaccattggagaagtccgatgggctgttcgcccaggaccgggaccctcgcttcagcgagatttaccataacattaacgcagatcagtctaaaggtattagctcatctacagtccccgccactcagcagctattttcacagggcaacacatttccacctactcccaggcccgccgagaacttccgaaattctgggctggcaccacctgtcacaattgtgcagccctccgcttctgcaggccaaatgctggcccagatcagccgccacagcaacccaacccagggagcaacaccgacatggacgccaactacaaggtctggttttagcgcccagcaggtcgcgactcaggccacggctaagaccagaacctcccaattcggagtcggatccttccaaaccccttccagcttctccagcatgtcccttcctggagcccccacagctagtccgggagcagctgcctatccgagtttgacgaatcggggctcaaatttcgctcctgagacggggcagacggctggtcagttccagacgcggactgctgagggagttggcgtgtggccacagtggcaaggccagcagccacaccaccgttcttcgagcagcgaacagcatgtgcaacagccaccggcccagcagccaggacaaccggaagtgttccaggagatgctgtctatgttgggagatcaatccaacagctacaacaatgaagagttcccagaccttactatgtttccgcccttcagcgaa

SEQ ID NO: 26135 - DNA, 2367 bp, Artificial Sequence
  Description of Artificial Sequence: Synthetic coding sequence
atggcggctaccaccgctaatccagaaatgacaagcgatgtcccgtcgctgggccccgccatcgctagtgggaactctgggcctggcatacagggaggaggggccatcgtgcagcgggctatcaaacggagaccgggccttgactttgacgacgatggagaaggaaatagcaagttcctgcgatgcgacgacgaccagatgtcaaacgacaaagagagattcgccaggagcgatgatgaacaaagtagtgcagataaggagaggctcgcgcgagagaaccactccgagatagaacgcagacgccggaataagatgaccgcatatatcacagagcttagtgacatggtcccgacctgcagcgctcttgcccggaaacctgataaactgactatattgcggatggcggtgtcccatatgaaatccctccgtggaacgggcaacacgagtacggatggctcctataagcctagtttcctcactgaccaggagcttaagcacctaattttagaggccgctgacggtttccttttcatagtaagttgcgaaacgggccgggtggtctacgtcagcgacagtgtgactcctgtgctcaaccagcctcagtcggagtggttcggaagtactctctacgatcaggtccaccctgatgatgtggacaagcttagggagcagctgagtacgtcggaaaacgccctgactggccgaattctggatctgaagacggggacagtgaagaaggagggtcaacagagctccatgagaatgtgtatgggaagcaggcgatcctttatctgtagaatgaggtgtgggtcctcctccgttgatccagttagcgtcaatcgactgtccttcgtgcggaatcgatgcagaaatggcttaggaagcgtgaaagacggcgagccccattttgtagttgtgcattgcactgggtacatcaaggcgtggccaccagctggcgtgtctttgccagacgatgacccagaggctggacaaggcagcaagttctgccttgttgccatcggccggcttcaggtcaccagcagccccaattgtaccgatatgagtaatgtttgccaaccgaccgaattcattagccggcacaacattgaaggtatcttcacgttcgtggaccacagatgcgttgcaaccgtgggctaccaaccacaggagttactgggcaagaacattgtcgagttttgccaccccgaagatcagcaactcctgcgcgacagctttcaacaagtagtgaaactcaagggtcaagtgttgtcagtgatgtttcgattcaggagcaagaatcaggagtggctgtggatgagaacatcctcctttacattccagaacccctactcagacgagatcgagtacattatctgtacaaacacgaacgtcaaaaactcatcccaggagccacgccccacgttgagcaatactatccagcggccacagctcggcccgacagcaaatctgcccctcgaaatggggagcgggcagctcgctccccgccaacaacagcaacaaacagagctcgatatggttccagggagagacggtctcgcctcttacaaccacagccaggtcgtgcaaccggtgaccactaccgggccagaacactcaaaacccttagagaagagcgacggactgttcgctcaagatcgggatccaaggtttagcgagatttaccacaacatcaacgccgaccagagtaaaggcatttcttcctccaccgtgcctgccacccagcaacttttttcccagggaaataccttcccccccacgccacgcccggccgagaacttccgcaactcgggactcgccccacctgtgacaattgtccagccgtctgcatctgccggtcagatgctggcccagatctcacgccattctaaccctactcagggggcaacacctacatggaccccaactactaggagtggattctctgcccagcaggttgccactcaggcaaccgccaaaacccggaccagccaattcggtgtggggtcatttcaaaccccgtctagtttctctagtatgagcttaccaggagcccctacagcatcccctggcgccgcagcatacccatcattaaccaatcgcggatcgaactttgcacccgagacaggacagaccgctggacaatttcagactagaacagcagagggagtgggggtgtggccgcagtggcaggggcagcagccccaccacagatccagtagttccgaacagcatgtgcagcaacctccagcccagcaaccagggcagcccgaagtgtttcaggagatgctaagcatgctgggtgatcaaagcaatagctacaataacgaggaatttccagacttaaccatgttcccccctttcagcgag

SEQ ID NO: 26136 - DNA, 2367 bp, Artificial Sequence
  Description of Artificial Sequence: Synthetic coding sequence
atggccgctacaactgcaaatccagagatgacatctgatgtgccctcgctaggacccgctattgcctccggaaatagtggacctggaatacaggggggaggagctatcgtacagcgggctatcaaacgacggcctgggctcgatttcgatgatgatggggaaggaaactccaaatttctacggtgcgatgatgatcagatgtccaacgataaagagcggtttgctaggtctgatgatgagcagtcatccgcagataaagagcgtttagcacgggaaaatcactcagaaatagaacgccgacgacgcaataaaatgactgcctacataacagagctttccgacatggtaccaacatgttccgcactggctaggaaacctgacaaactaacaatacttcgaatggccgtctcacatatgaaatctctcaggggaactggaaacacgtctactgatggatcttataaacccagtttcctaacagatcaggagctcaagcatctcatcttggaagcagctgatgggtttcttttcatcgtcagttgcgagacagggagggtggtgtatgtgtccgattctgtaacacccgttcttaaccagcctcagtctgaatggttcggatccactctctacgatcaggtccatccagatgatgttgataaattgagggaacagctctcaacttcggaaaatgccctcactgggcgaattctcgatttaaagacaggaactgtaaagaaagaaggacagcagtcttccatgagaatgtgcatgggatctcgaagatccttcatctgtcggatgagatgcggaagttcttcagtagatccagtgtccgtcaaccgactctcttttgtcagaaacaggtgtcggaatgggttggggtctgtaaaagacggagaaccccattttgtagtcgtgcactgcactgggtacattaaagcatggcctcctgctggggtttctttgcctgatgatgatcctgaggccggacagggatccaaattctgcctcgtggccataggacgactccaggtcacttctagtcctaattgtacggacatgtcaaatgtttgccagcccactgaatttatatctagacataatatcgaaggaatcttcacttttgtagatcataggtgtgtcgcaactgttgggtaccagccacaggaacttctggggaaaaatatagtcgaattttgccatcctgaagatcaacagttgcttagggattcttttcagcaggtcgtgaaactaaaggggcaggtgctctctgttatgttccggtttcgctctaaaaaccaggaatggctatggatgagaacatcatctttcacatttcagaatccctattctgatgaaatcgaatacataatatgtactaatacaaacgtaaaaaattcaagtcaggaaccacgccctactctctcaaacactatacagaggccccagctgggacctacagcaaacctcccacttgagatgggatcaggacagctcgcccctaggcagcaacagcagcagactgaactagatatggtcccagggcgggatggactcgcctcttataatcattctcaggtcgttcagccagtgacaacgacaggacccgaacacagtaaacccctcgaaaaatccgacggactctttgctcaggaccgagatcccagattttcggaaatctatcacaacatcaacgcggatcagagtaaagggatctcctctagtactgtccccgccacacaacagcttttttctcagggaaacacattccccccaacaccacgaccagctgaaaacttccgcaactcaggactggccccaccagtgacaatcgttcagcctagtgctagtgctgggcaaatgctcgctcagataagtagacactccaaccctactcagggagctactcctacttggactcctactacacgaagtgggttttctgcacaacaggtggccacacaggcgactgcaaaaacaaggacttcacagttcggggtagggtcttttcagactcctagttccttctcatctatgtcactgcccggggccccaactgcatccccaggagccgcagcctatccttccctcactaacaggggatctaactttgcacctgaaacaggacagactgcgggacagttccaaacacggactgctgaaggagtaggagtatggccacagtggcagggacagcagcctcaccatcggtcttcttcctccgaacagcacgtacagcaaccacctgctcagcagcctggacagcccgaagtgtttcaggaaatgctctctatgttgggggatcaatcaaactcctacaataacgaggaatttcctgatctcactatgttcccccccttctccgag

SEQ ID NO: 26137 - DNA, 2367 bp, Artificial Sequence
  Description of Artificial Sequence: Synthetic coding sequence
atggccgcaactaccgccaatcccgaaatgacatccgatgttccaagtctgggtcccgctatagcttcaggcaatagcggccccggaatacaggggggcggagctattgtgcaacgagccattaagaggcggcctggattggatttcgacgatgatggggaggggaactccaaatttcttcggtgcgatgatgaccagatgagcaacgacaaggagagattcgcgcgatccgacgatgaacagagcagtgcagacaaagaacgccttgcacgggagaaccactccgaaatcgaaaggcgaagacgcaacaagatgacggcctacatcactgagctgagtgacatggtcccgacttgtagcgccctcgcccggaagcctgataaacttaccatcttgaggatggcagtgtcacatatgaagtcattgcgcggcaccggtaacacgagcactgatggctcctacaaaccctcatttctgacagaccaggagctgaagcatctgatcctggaagccgccgacggcttcctgttcatcgtgtcctgcgagacgggaagagtggtgtatgtgtccgattctgtgacccccgttctgaaccagcctcagtccgagtggttcggatctacactgtatgatcaagtacatcctgacgatgttgataaattgcgagaacaactctctactagtgagaatgccctgactgggagaattctggacctgaagaccggcaccgtcaaaaaagaaggacagcagtcatccatgaggatgtgtatgggctcacgccggtccttcatttgtagaatgagatgcggctcctcaagcgtggaccccgtcagcgttaaccgactgagcttcgtgcggaaccgatgtcggaatggcttgggaagtgtgaaggacggagaacctcatttcgtggtggtccactgcaccggctacatcaaagcatggcctccagcaggagtcagtttgcctgatgacgaccccgaagcgggacaggggagcaagttctgtcttgtggcgatcgggaggctgcaggtgacgagctcccccaactgcacagatatgagcaatgtgtgtcagccaaccgaattcatctcccgccacaatatagagggaatttttacgtttgtggatcaccgctgcgtagccaccgtgggatatcagcctcaggagctgctgggcaagaacatcgttgagttctgccaccccgaagaccaacagctcctgagggacagttttcagcaggtggtcaagctcaagggccaggtgctgtccgttatgttccgattcagatccaaaaatcaggagtggctttggatgcgcacaagcagttttacattccagaatccctactccgatgaaattgaatacataatttgtactaatactaatgttaaaaatagctcacaggaaccccgacctaccctgagtaataccatccaacggccacagctcgggccaaccgcgaacctgcccctggagatgggcagcggccaactggccccccgccagcagcagcagcaaaccgaactcgacatggtccccggccgggacgggctcgccagctacaaccattctcaggtggtgcaacccgtaactaccacggggcccgagcacagcaaaccccttgaaaaaagcgatgggctttttgcccaggatagagatccccgattcagtgagatctaccacaacataaacgcagaccagtccaagggaatctcctctagcaccgtccctgccacccagcaactcttcagccagggcaacacatttccccccactccgcggcccgccgaaaacttcaggaattctgggctcgctccacccgtgactatcgtgcaaccgtccgccagtgctggccagatgctggctcaaatctcacggcatagcaatcctacacagggcgctactcccacctggacccctaccaccaggtctgggttctcagcacagcaggtcgccacacaggctaccgccaagacccgaacatctcagttcggggttggcagctttcagactccctcttccttttcaagtatgagcctgcctggcgcacccactgcctcccctggcgccgcagcctatccttccctgaccaatcgcggcagcaattttgccccagagacgggacaaactgccggccaattccagacaaggaccgccgaaggagtgggcgtctggccccagtggcagggccagcagccccaccaccgctcttcatccagtgagcagcacgtgcaacaaccacccgcgcaacagccagggcagccagaggtgtttcaagagatgctcagtatgctcggtgaccaaagcaacagctacaacaacgaagagtttcctgacctgactatgttccccccgttcagcgag

SEQ ID NO: 26138 - DNA, 2367 bp, Artificial Sequence
  Description of Artificial Sequence: Synthetic coding sequence
atggccgctaccactgccaaccctgagatgacatctgatgttcctagtctgggcccggctattgcatcagggaacagtggtcctggtattcagggaggcggtgcaattgtgcagcgagctatcaagaggcggcctggccttgacttcgatgatgacggcgaaggcaactccaaatttctcaggtgtgacgacgaccagatgagcaacgataaggagcggtttgcccgcagtgacgacgaacagtccagtgccgacaaggagcggctggcccgggagaatcattccgaaatcgaaaggaggaggcggaacaagatgaccgcgtatatcaccgagctcagtgatatggtgccaacctgctcggccctggccagaaagcctgataagcttacaatcctgagaatggctgtcagccacatgaaaagcttaagaggaactggcaacacctctacggacggaagctacaaaccgagctttttgacagaccaggagctgaagcatcttatcttagaggccgcggatggttttttgttcattgtgagttgcgagactgggcgcgtggtctacgtgagcgatagtgtgacacctgtgctgaatcaaccgcagtccgaatggttcgggtcaacactatacgatcaggtgcaccctgatgacgtggataagcttcgagaacagctgtccacctccgagaacgctttgaccgggcgtatactcgacttaaagacaggcacggtaaagaaagagggacaacaatccagtatgcgcatgtgcatgggtagccgcagaagctttatttgtcgtatgcgttgcggctcgtcctcagtcgatcccgttagtgtgaacaggttgagtttcgttaggaatcgctgccggaatggcctggggagcgtgaaagatggcgaaccccatttcgtcgtggtacactgcacgggctatatcaaggcttggccacccgcaggggtgagcctgcctgatgacgacccagaggccgggcagggctctaaattctgcctggtagcgattggtcgactgcaggtgacgtcctctccaaattgcacagatatgtcaaacgtttgtcagcctactgaatttatctctcgtcataatatagagggcatctttacgtttgtcgatcaccggtgtgtggctacagtcggctatcaacctcaagagctactgggaaagaacatagtggaattttgccaccccgaagatcagcagctgctgagggattcttttcagcaagtagtcaagcttaagggacaggtgctgagtgtaatgtttcgatttcggagtaagaaccaagaatggctgtggatgcgcacctcatctttcacgtttcagaacccttactccgatgaaatcgaatatatcatttgtacgaatactaacgttaagaactctagccaagagcccagaccaacgctgagtaatactatccagcggccccagctggggcccaccgccaatctgcctttggaaatgggatctggacagttggcgcctcgccaacagcagcagcagacagagttggatatggtccccggcagggatggtctggctagttacaaccacagccaggtggtgcaacccgttacaactactggcccggaacactctaagcctctcgagaagtccgatgggcttttcgcccaggatcgggatccacggttttcagagatataccacaacattaatgctgatcagagcaaaggtatctcatctagcacagtccccgcaacccagcagctgttttcacagggaaatacctttcctcctactccaagacccgctgagaactttcggaacagcggcctcgccccccccgtgactatagtgcagccatctgctagcgccggacagatgctcgcccaaatttctagacacagcaacccaactcagggagcaacccccacttggaccccgaccacaagaagtggttttagtgcccagcaggtggccacccaggccaccgccaaaacacgaacgtcccagttcggggtgggctcgttccagacaccgtcatcattcagctccatgagtctgcccggcgctcccacagcctcgccaggtgccgctgcttaccccagtttgacaaaccgggggtctaatttcgctccggagacgggacaaactgcaggccagtttcagactaggaccgctgaaggcgtgggcgtttggccacagtggcagggacaacagccccaccatcggtccagctcttccgagcagcacgtgcaacagccccccgctcagcagccaggccagccggaggtgtttcaggaaatgctgtctatgctgggcgatcagagcaactcttacaataacgaggagtttcctgacttaacgatgtttccccctttctccgag

SEQ ID NO: 26139 - DNA, 2367 bp, Artificial Sequence
  Description of Artificial Sequence: Synthetic coding sequence
atggccgcaaccactgcaaaccctgagatgacatccgacgttccaagtctgggaccagcaatagcatccgggaactctggccctggaatccaaggaggtggagctatcgttcagagagcgatcaaaagaagacctggattggattttgacgacgatggagaagggaactctaagttcctgagatgcgacgacgaccagatgagcaatgacaaggaacggttcgccaggtcagatgatgagcaaagcagtgctgataaggagcggcttgcccgcgaaaaccacagcgagattgagaggcgcaggcgtaataagatgacagcgtatatcacagaactttcagatatggtacctacctgctcggctctagctagaaaacccgacaagctgaccattctgaggatggctgtcagccacatgaagagtctccgcgggacaggaaacacaagcaccgacggttcctataagccttccttcctcaccgaccaagagctgaagcatctgatactggaggcagccgatggatttctgtttatagtcagctgcgaaacggggagagttgtgtacgtctctgattccgtgacccctgtgttgaaccagccccagagcgaatggttcggcagcacactgtacgaccaagtacatcctgatgacgtcgataagcttagggagcagctcagcacatctgaaaacgcattgacaggacgtatccttgacttgaaaaccggcaccgtgaaaaaagaaggacagcagagtagcatgagaatgtgtatgggctctaggagaagctttatatgcaggatgaggtgcggtagctcctcagtggacccagtctcagtgaaccgtctaagctttgtccggaaccgctgtcggaacggactgggaagcgtgaaggatggagaaccgcacttcgtggtggtccattgcacaggttacatcaaagcctggccacccgccggggtgagtctgccagacgacgatccagaggctggacagggctccaagttctgcctggtggccattggcagacttcaggtgacctcatctcccaactgtacagatatgtccaacgtgtgccagcccacggaattcatttcacgacacaacattgagggcatcttcacattcgtcgatcacaggtgtgtcgcaaccgtaggttatcagccacaagagctcctaggcaaaaatatcgtggagttttgccacccagaagatcagcaactgctcagagattcttttcaacaggtggtcaagcttaagggccaggtacttagcgtgatgtttagattcagaagcaaaaaccaagaatggctgtggatgcggacctcttcatttactttccagaacccttattctgacgaaatcgagtacataatctgtactaacaccaacgttaaaaactcgtctcaagaaccaaggccaacactgtcaaacacaattcaaaggcctcagcttggtccgaccgccaacctccctctggagatgggatcaggtcaactggcacctagacagcagcaacagcaaaccgagttggacatggtccccggacgagatggtctggcgtcctacaaccactctcaggtggtccaaccagttacaacgacaggtcctgagcacagcaagcccctcgaaaagagcgatggacttttcgcccaggaccgagatccaaggtttagtgagatctaccataatatcaatgcggatcaatctaagggtatctcaagcagtaccgtccctgctacccagcagctgttttcacaaggtaatacattcccaccaaccccccgccctgcggagaattttagaaacagtggactggctccacctgttacaatcgttcagccaagtgcaagcgcaggccagatgctcgcacaaatcagccgtcacagcaacccaacacagggagctacacccacctggaccccaactaccagaagcggctttagcgctcagcaggtagccactcaggctaccgccaaaactaggaccagccaattcggagtgggatccttccagacaccaagtagcttcagttccatgtctctcccaggcgctcctacagcgagcccaggagcagctgcttatccgagccttacaaacagggggtccaacttcgctcctgaaacaggacagaccgccggccagtttcagacaaggactgctgagggagtaggagtctggcctcaatggcaaggccagcagcctcaccatagaagctcttcttcagaacagcacgtgcagcagccacccgctcaacagcctggccagccagaagtctttcaggaaatgttgagtatgctgggggatcagtccaactcttataataacgaggagtttcccgacctgaccatgttccccccctttagcgaa

SEQ ID NO: 26140 - DNA, 2367 bp, Artificial Sequence
  Description of Artificial Sequence: Synthetic coding sequence
atggcggctaccaccgcaaaccccgaaatgactagtgatgtgccctcactgggccctgccatagcctccggcaatagtggcccaggaatccaaggcggaggtgcgattgtgcagagggctatcaaaaggagacccggattggacttcgatgatgacggtgaaggaaatagcaagttcttacgctgcgatgatgaccagatgtctaatgacaaggagaggtttgccagaagtgacgacgagcagagctcagccgacaaggagcgcttggcccgtgaaaatcattcagagattgagagaagaagaagaaataagatgactgcgtacatcactgagttatctgacatggtcccaacctgtagcgcgttggcaagaaaaccagataaactgaccattctcagaatggccgtttctcacatgaagtccctgagaggcaccggcaacaccagcaccgacggaagttataagccctcattcctcacagaccaggaactgaaacacctgattttagaggcagcggacgggttcctgtttattgttagctgcgaaaccggacgggttgtttatgtgtctgactccgttactcctgtgctaaatcagcctcagtctgagtggtttggcagcacactatacgaccaggtacatccagatgacgtcgacaaacttcgggagcagttgagtacgtcagagaacgctctgacaggtaggattctagaccttaaaaccggcacagtaaagaaagagggccagcagagcagtatgagaatgtgtatgggtagcagaaggtcgttcatatgtaggatgcgctgcggttcttccagtgtcgatcccgtctcagtcaatcggttgtccttcgtgaggaataggtgccggaacggactgggatctgtgaaggacggcgagccgcactttgtcgttgtccactgtactggatacataaaagcatggccacctgctggagtgagtttgccggacgacgaccctgaggccggccagggctccaaattctgtctcgttgccattgggcgacttcaggtgacaagctcccccaactgcacagatatgtcaaatgtgtgtcagccaaccgaattcatatcccggcataacattgagggcatattcacattcgtggaccataggtgcgtggccaccgtaggctatcagccccaggagttgctcggaaagaacatcgttgagttctgccacccggaggatcaacaactgttgcgggactccttccagcaagtggtaaagctcaagggccaggtgctctctgtgatgttcaggtttcgatcaaagaaccaggagtggctgtggatgcgcacatctagttttaccttccagaatccttactccgacgagattgagtacatcatttgcacaaacacaaacgtcaagaactcatcacaggagccacgaccgaccttgagcaatacaatccaaaggccccagcttgggccaaccgcaaatctcccgttagaaatgggatccggccagctagctcctcgacagcaacagcagcagactgaattggatatggtacccggtcgtgatggcctagcatcgtataatcactctcaagtagtccagccagtaacaacgactggacccgaacactctaaacccctcgaaaagagcgatggccttttcgcccaggatcgggaccctaggttcagcgaaatttaccacaacataaatgcagaccagtctaaagggatcagttcatcaaccgttccagctactcagcaacttttctcccaaggaaatactttcccccctactcctcggccagccgagaatttccgcaacagtgggcttgcaccacccgtgactattgtccagccatcagctagcgccggccagatgctggcccaaattagtcgccactccaaccccacccagggtgcgactcctacgtggacaccgactacaaggtcaggattctctgcccagcaggtggctacacaagcaaccgcaaaaacacgtacttcccagtttggagtgggatcatttcagacaccgtcatcctttagctctatgagtctcccgggcgcgcccaccgcgtcccctggagccgccgcatacccgtcacttacaaatcgaggatctaactttgcacccgagaccggccagactgctggtcagtttcagacgagaaccgcagaaggcgtgggcgtatggcctcagtggcaggggcagcagccacaccataggtcgagtagctccgaacagcacgtgcagcaacccccagcacagcagcctgggcagcctgaggtgttccaagagatgttatctatgctgggtgatcagtccaactcatacaacaatgaggagtttccagacctcacgatgttccctcctttctccgaa

SEQ ID NO: 26141 - DNA, 2367 bp, Artificial Sequence
  Description of Artificial Sequence: Synthetic coding sequence
atggccgccacgactgctaacccggagatgaccagcgacgtgccctctctgggtccagccatcgcttctggtaattctggaccagggatccaaggaggtggggctattgtgcagcgcgctataaagaggaggcctggcctggactttgacgatgatggagagggaaactctaagttcctcagatgcgatgatgaccagatgtcgaacgataaagagcgcttcgctcgctcagacgatgaacagagctctgctgataaggagcggttggccagagagaaccacagtgaaatagagcgtagaaggcgtaacaaaatgactgcatacatcacagaattgagcgatatggtccctacctgcagcgcccttgctaggaaacccgacaaattgaccatcctcaggatggcagttagccatatgaaaagccttcgcggcaccgggaacacttcaacagacggatcttataaacctagcttcctcaccgaccaggagttgaaacatctcattctcgaggctgcagatggatttctattcattgtttcctgcgagaccggccgggtggtatacgtctccgactcagtgacccccgttctgaaccaaccccagagcgagtggttcggcagcaccctttacgatcaggtccacccagacgatgttgacaaattgagggagcagctctctacatctgaaaatgccctcaccggacgcatccttgacctgaagactggcactgttaaaaaagaaggtcagcagagctcaatgaggatgtgtatgggcagtcgccgctcttttatttgtagaatgagatgtgggagcagttctgtggatccggtctctgtgaatcggctttcattcgtgagaaatcgatgcaggaatggcctcggaagcgtcaaggacggcgagccacacttcgtggtggtgcattgtaccggttatataaaagcctggccaccggcaggggtaagcttgcctgatgatgatcccgaggctggacagggcagcaagttttgtcttgtggctatcgggaggctgcaggttacttcttcaccgaactgcactgacatgagtaatgtttgccagccaaccgaatttatctctagacataatatcgagggaattttcacatttgtagaccacagatgtgtagctaccgtaggctaccaacctcaagagttgcttggaaagaatattgtcgagttctgccatccagaggatcaacaattgctgagagacagcttccaacaggttgtgaagttgaagggccaggtcctgtcagtgatgtttcggttccgcagcaaaaaccaagaatggctgtggatgaggacatcatcttttacttttcagaacccttactctgatgagatcgagtacatcatatgcaccaacacaaacgtgaagaactcttcccaggagcccaggcccacgctcagcaacactattcagagaccccagttaggacccacggctaacctccctctggagatgggctctggacagttggcaccaagacagcaacaacagcagacagaactggacatggtacccggtagagatgggctggccagttacaaccattcccaggtggtccagccagtcaccactacaggtccagagcactctaaaccgctggaaaagtctgatggactgtttgctcaagacagggatcctaggttttcagagatttatcataacataaatgcggaccaatcaaaaggtatatcgagctcaaccgtcccggccacacagcagctgttcagtcagggcaacacatttcctcctactcctcgtccagctgagaacttccgcaattcaggcctggctcctcccgtaaccatcgtgcaaccatctgctagtgctggccagatgttggcccagattagcagacattctaaccctacacaaggggcgactcctacttggaccccaaccaccaggtccggcttcagcgcccaacaggtggccacccaagctacagccaagactagaacatctcaatttggagtaggctccttccaaacccccagctcctttagtagtatgtcattgcccggagcaccaacagccagcccaggtgccgccgcctatcctagcctgacaaatcggggcagtaacttcgctccagaaacaggccagacggcagggcagtttcagacaaggactgccgagggcgttggagtttggcctcagtggcaagggcagcagccccaccaccgctcttcttcttccgaacagcatgtgcagcagccccctgcccagcaaccaggacagccagaagtgtttcaggagatgctgagcatgttgggagatcaaagtaacagttacaataacgaagagtttcctgatctgaccatgtttccaccgttttccgaa

SEQ ID NO: 26142 - DNA, 2367 bp, Artificial Sequence
  Description of Artificial Sequence: Synthetic coding sequence
atggcagcgacaaccgccaatccagagatgacaagcgatgtaccttccctagggccagcaatagcctctggcaactccggacccggaatccagggcgggggcgctatcgtacagcgcgccattaaaaggcgccctggactagatttcgacgacgacggcgagggcaacagcaaattcttgcgatgtgacgacgaccagatgagcaacgacaaagagcggtttgccagaagcgacgacgagcagtcctccgccgataaggagcgtcttgcccgagagaaccacagcgagatcgagaggcgcaggagaaacaagatgacggcctatataacagagctgagcgacatggtccccacatgttccgctttggccagaaagcccgataagctcactattttacgtatggcggtgagtcacatgaaatccctgcgagggacaggcaatacgtccacggacggcagttacaaaccatccttcttgacagatcaggagctcaagcatctgatactggaggcggccgatggcttcctcttcatcgtcagctgtgagactgggcgggtggtgtacgtctcagattctgtcacccccgtactcaatcaaccccagtctgaatggtttggcagcaccctgtacgatcaggtacatccggacgacgtggacaagctccgggagcagttgagcacatccgagaatgccctgacgggacgtattctagatctaaagaccggtactgtgaaaaaagagggccagcagagcagtatgagaatgtgcatgggttctaggaggtctttcatctgcaggatgcgctgtggatcctcatcagtggaccccgttagtgttaaccggttgtctttcgtgcgtaaccgctgtaggaacgggttgggttccgttaaggatggggagcctcacttcgtagtcgtgcactgcaccggctatatcaaggcctggccccccgcgggggtgagcctgcccgatgacgacccagaagctggtcagggctccaagttctgtctggtcgctatcgggcggctgcaggttacgagctcacccaattgtacagatatgagcaatgtctgccagccaaccgagtttatctccaggcacaatatcgagggaatcttcacctttgtggatcatcgatgtgtggcaacagtgggctatcagcctcaggagttactgggcaaaaacatcgttgagttttgccacccagaggaccagcagctcctgcgggacagtttccagcaagtggttaagctgaagggccaggtgctcagcgtgatgtttaggtttaggtccaagaaccaagagtggctgtggatgcgcacctcttcatttaccttccagaacccttactcagacgagatagaatacattatctgcaccaacactaatgtgaaaaattccagccaggagccccgtcctactctgagtaacaccatccagcgccctcagctcgggccaaccgccaatctacctctggaaatgggaagtggccaactggcacctcgacagcagcagcaacaaaccgagctggacatggtgccaggacgtgatgggttggcctcttacaatcacagccaggtagttcagccggtaacaaccaccggacccgaacatagcaagccactcgaaaaatctgacggcctgttcgctcaggaccgggaccctaggttttccgagatctaccacaatatcaacgccgaccagagcaaaggaatctcttcctctactgtgcccgccacccagcagttgtttagccaggggaatacctttccgccaaccccccggcccgcggagaactttcgaaactctggactggctcctcctgtgacgattgttcagccttccgcttcggccggtcagatgctggctcagatttctaggcactctaaccctacgcagggtgctacacccacatggacccccacaaccaggagcggattctctgctcagcaggtggccacacaagcaaccgccaagaccagaaccagccaattcggagtgggttctttccaaaccccctccagcttcagcagtatgtccctgcctggcgcccccaccgcaagtcccggagcagccgcctacccttctttgacaaatcggggatccaactttgcccccgagactggccagacggccggccagttccagacaaggaccgccgaaggagtgggtgtatggccacagtggcagggccagcaaccgcaccaccgaagttcctcctccgaacagcacgttcagcaaccccccgcacagcagccgggtcaacctgaagtgtttcaggaaatgctgtctatgctgggcgaccagtccaatagttataacaacgaggaattcccagatctgacaatgtttcctcctttcagcgag

SEQ ID NO: 26143 - DNA, 2367 bp, Artificial Sequence
  Description of Artificial Sequence: Synthetic coding sequence
atggccgcaaccaccgcgaaccctgagatgacgtcggatgtgccgtccctggggcctgcaatcgcgtccggaaattcaggcccaggcattcaaggagggggagcgattgtgcaacgggcgatcaaacgcagaccgggactggacttcgatgacgacggcgagggcaactccaaattccttcggtgcgatgacgatcagatgtctaacgacaaggagcgctttgcaagatccgatgatgaacagtcgtcggccgacaaggaaagactcgctcgcgaaaatcactcagaaattgagagacgccgtaggaataagatgaccgcctacatcaccgaactgtccgacatggttcccacttgctccgctctggctcgcaagccggacaaactgaccattttgcgcatggccgtgagccacatgaaatcactgcgcggaaccgggaacacttccactgacggaagctacaagccatccttcctcaccgatcaggagctgaaacatctgatcctcgaggcggctgacggattcttgttcatcgtctcgtgtgagacgggcagagtcgtttacgtgtccgattccgtgaccccggtgctcaaccagccgcaatctgaatggtttgggtcgaccctttacgaccaggtgcatccagacgacgtcgacaagctgcgcgaacagctcagcacgagcgaaaacgccctgacgggacgaattctggaccttaagaccggcactgtgaagaaagaaggacagcaaagctcgatgagaatgtgcatgggttcacggcgctcgttcatctgccgcatgcgctgcggatcctcgtcggtggacccagtgtcagttaacaggctcagctttgtccgcaataggtgtcggaatggcctggggtccgtgaaggacggagagccgcacttcgtggtggtccactgcactggctacatcaaggcttggcctccggcaggcgtgtcgcttccggacgatgatccggaagcaggacaagggtcgaagttctgcctggtggcgatcggaaggttgcaagtcacttcaagcccgaattgcaccgacatgtcaaatgtgtgtcaaccaaccgaattcatcagccggcacaacatcgagggaatctttactttcgtcgatcaccggtgcgtcgccaccgtgggttaccagccgcaagagttgctcgggaagaacatcgtggagttttgtcacccggaagatcaacagctgctgagggatagcttccaacaggtggtcaagctcaagggacaggtgctttcggtgatgttccgcttccggtccaagaatcaggaatggctgtggatgcggaccagcagctttactttccaaaacccgtactcggacgaaatcgagtacatcatctgcaccaatactaacgtgaagaactcgagccaagaacccaggccgactctctccaacactatccaaagacctcagctgggaccaaccgccaatctcccactggagatgggctccgggcagttggcccctagacagcaacagcagcagaccgagctcgatatggtgccgggacgggacgggctcgcatcctacaaccatagccaggtcgtgcaaccagtcacgactactggtccagaacacagcaaaccgctggaaaagtcagatggactgttcgcgcaagaccgggatccacgcttctccgagatctaccacaatatcaacgccgaccaaagcaaaggaatctcgtcgtcaactgtccctgctactcagcagctcttctcgcaaggaaacaccttccctccgacgccacggcctgccgaaaacttccgaaactccggcctggcgcctcccgtgactattgtccagccttccgcctcagccggacaaatgctcgctcagatcagcagacattccaaccccacccagggtgcgacccccacttggacccccaccactcggtcgggattctcagcgcaacaggtggccacccaggccaccgccaagactcgcaccagccagttcggcgtgggatcattccagaccccgtcctctttctcctccatgtcactgccgggagccccgaccgcctcaccgggagcagccgcatatccgtcgctgaccaacagaggctcaaactttgctccggaaactggacagacggcaggtcagtttcagactcggactgcggaaggagtgggcgtttggccacagtggcagggtcagcagccgcatcaccggtcaagcagctcggaacaacatgtccagcagcctcctgcccagcagccaggtcaaccagaggtgttccaagagatgttgagcatgctgggagatcagtcgaattcatacaataacgaggagtttccggacctgactatgtttcccccattctcggaa

SEQ ID NO: 26144 - DNA, 2367 bp, Artificial Sequence
  Description of Artificial Sequence: Synthetic coding sequence
atggcggccaccactgccaacccagagatgaccagtgatgtcccctcactggggccggctattgcttcaggcaattccggccccggcatacagggcggaggggcaattgttcagcgggcaattaagagacggcctggcttagattttgatgatgatggtgagggcaattcgaaatttctgcggtgtgatgacgatcagatgagcaacgataaggagcggttcgccagaagtgacgatgagcagagctcggctgataaggaaagattggcacgggaaaatcactccgagatcgagcggaggaggcggaataagatgaccgcatatataaccgagctttcagatatggttcccacctgttcagccctggcgcggaaaccagacaaactgaccatcctcaggatggccgtcagtcacatgaagagcctcagaggcactggtaatacttcgacagatgggtcctacaagccatcgtttcttacagaccaggagctcaaacacttgatcctggaagctgctgatggctttcttttcatagtgtcctgtgaaactggaagggtagtgtacgtgtcggattcagtgactcccgtgctgaatcaaccccagtctgaatggttcgggagtacgctgtacgaccaggtccaccccgatgatgtggataagctgagggaacagttatccacatcagagaacgcgttgactggccgaatcctcgacctgaagacgggtaccgtcaagaaggaggggcagcagtcgtctatgaggatgtgcatgggcagccgcaggtcttttatttgtaggatgcgatgcgggagttctagtgtggaccccgtgtccgtcaacaggctgtccttcgttcgtaatcgctgtagaaatggcctgggatccgttaaggacggcgaaccacattttgtagtggtccactgcacaggatacattaaggcctggccgcccgctggagtgtcgctacctgatgacgaccctgaggctggtcaggggtccaaattttgtctggtggcaataggcagactgcaggtaacaagtagcccgaactgtacagacatgtccaatgtgtgtcagcccacggagttcatatcccgacacaacattgagggcatttttacctttgtcgaccacaggtgtgtggccactgtgggctatcagcctcaagagctactggggaagaacatcgttgagttttgccatcctgaggatcagcagttgctgagggactccttccagcaagtggtcaaactcaaggggcaggtgctgtccgtgatgttcagattcagatccaagaatcaagagtggctgtggatgagaacctcctcgtttaccttccagaacccctactctgatgagatcgaatacataatatgcacaaacaccaatgtgaaaaacagctctcaggaaccccgccctacccttagcaacaccatccagcgtcctcagctgggccccacggcaaatctgccactggaaatgggctcagggcagctggcgccgcgtcagcaacagcaacagaccgaactggacatggtccccggcagagacggcctggcgtcatataaccactctcaggttgtgcagccagttacgactactggaccagaacactcaaagccactggaaaaatccgacggtttgttcgcacaggaccgtgatccccgcttttccgaaatctaccacaacatcaatgctgatcagtctaagggtatcagttcttcgaccgtaccagccacccagcagctatttagccaaggcaacaccttcccgcctaccccaagacccgctgagaacttcaggaattctgggctcgcccccccggtcactatagtgcagccaagcgcatctgccgggcaaatgctggcccagatttcgagacattccaaccccacacagggggccacgcccacttggacccccactacacgctcggggttcagtgcccagcaggtggccacccaggccacagctaaaaccaggacttcacagttcggtgtgggctcctttcaaactcctagcagtttttcttctatgtccttgcctggagctcctaccgcctcacctggcgcggcagcctaccctagcctgacaaacagaggctcaaactttgctccggaaactggccaaaccgccggccagtttcagacgaggaccgccgaaggagtgggtgtgtggcctcaatggcaagggcagcagccacaccatcgcagttcttcaagcgagcagcatgttcagcagccaccagcgcagcaaccagggcagccagaggttttccaggaaatgctgtccatgttgggggaccagtcgaatagttacaacaacgaggaattcccagacctgacaatgttccctccatttagtgaa

SEQ ID NO: 26145 - DNA, 2367 bp, Artificial Sequence
  Description of Artificial Sequence: Synthetic coding sequence
atggcagccactactgccaacccagaaatgacatccgatgtcccctctctggggccagccatcgcatcaggaaatagtgggcccggaatacagggagggggggctatagttcagcgggctatcaaacgccgaccagggcttgattttgatgacgatggagaagggaattctaaattcctaaggtgtgatgacgatcagatgtcaaacgataaagaaaggttcgcgagatctgatgacgaacagtcatccgcagataaagaacgcctcgccagagagaaccactcagaaatagaaaggaggaggaggaacaaaatgacagcctacattacagaacttagtgatatggtacccacatgctccgcattagctcggaaaccagataaactcacaattctgcgcatggccgtttcccacatgaaatctctcaggggaactgggaacacatccacagatgggtcttacaagccatcctttctcactgatcaggaactgaaacacctgattcttgaagccgcagatggatttcttttcattgtctcatgtgaaactgggagagtagtctatgtctcagactccgtgactcctgtactgaatcagcctcagtccgaatggtttggatcgacactttatgatcaggtacatcccgacgacgtagataagctacgtgaacagctctcgacgtctgaaaacgcccttactgggagaatcctggatctgaaaacaggaacagttaagaaagaaggacagcaatcttcgatgcggatgtgcatggggtctcgccggtccttcatttgtaggatgcggtgtgggtcatcatccgtggatcccgtttccgtgaaccgccttagtttcgtcagaaacaggtgtaggaacgggctaggatccgtgaaagatggagaaccccatttcgtggtagttcactgtactgggtatattaaagcatggccccccgctggggtctccctaccagatgatgatcctgaggccggacagggaagtaaattctgtcttgtagctatcgggcggctacaggtaacttcttctcctaattgcacagatatgtctaacgtgtgtcagccgactgagtttatctctaggcataatatcgaagggatttttacattcgtggatcatagatgtgtcgccactgtcggatatcagccacaggaactcctggggaaaaatatagtggaattctgccatcccgaagatcagcagttgctccgggattcattccagcaggtggtcaaactgaagggacaggtgctatcagtgatgttcaggttccggtcaaaaaatcaggagtggttgtggatgcgaacttcttcctttacatttcagaacccctatagtgacgaaatagagtacatcatctgcactaatactaacgtcaaaaactcttcccaggagccccgaccaactctgagtaacacaattcagaggccccagctggggcccacagcaaatctaccacttgaaatgggatccgggcaactcgccccacgacagcaacagcagcagactgaactagatatggttccagggagggatgggctcgcttcctacaaccacagtcaggtggtacagcccgtgactactacaggaccagaacatagtaagcccctggaaaaaagtgatggactgtttgcccaggatcgagatcctcgattctctgagatctatcacaatataaatgccgatcaatctaaaggaatttctagttcaacagttcccgcaacacagcagctgttttcgcaggggaacacttttcctcccacacctcgccccgcagaaaacttccggaattctggactcgcaccacctgtgactatagttcagccttccgccagtgccggacagatgctggcccaaatctccaggcatagtaatccaacgcagggggccactcctacttggacaccaactactaggtctggattctctgctcagcaggtcgcaacacaggcaacagctaaaacacgcacaagtcagtttggagtaggaagtttccaaactcctagttctttttcctcgatgagtctccctggggcaccaactgctagtccaggggcagccgcatacccctccttaacaaatcgcgggtctaatttcgcccccgaaacaggacagactgctggacagtttcagactcggacagccgagggggttggggtctggcctcagtggcagggacagcagccacaccataggtcctctagttcagaacagcacgtccagcaaccccctgcccaacagcccgggcagccagaagtgttccaggaaatgctgtccatgctaggagatcagtcaaattcttataacaatgaggagttccccgatcttactatgtttccaccattttcagaa

SEQ ID NO: 26146 - DNA, 2367 bp, Artificial Sequence
  Description of Artificial Sequence: Synthetic coding sequence
atggcagccaccacagctaatcctgaaatgactagcgacgtgccatcactggggcccgcaatcgcatcgggtaattctggacctggtatccagggcggaggagccatagtgcaaagggctataaagaggaggccgggattagatttcgacgatgatggagaggggaattccaagttcctgcgctgcgatgacgaccagatgtcaaacgacaaagaaaggtttgccagaagcgacgacgagcagtcaagtgccgataaggagcgactggcacgcgagaatcacagtgagatagagagacgccggcgcaacaagatgactgcctacattaccgaattgtctgacatggtgcctacctgcagcgcactggctaggaagcctgacaagcttactatcttacgcatggccgtaagtcatatgaaatccctaaggggaaccgggaacacctcaaccgatggatcttacaagccatcttttttgaccgatcaggaattgaagcatctgatactggaggccgctgatggatttctttttattgtctcctgtgaaacaggcagagttgtttacgttagcgacagcgttactccagtcctgaatcaaccccaaagcgaatggttcggctcgacactctacgatcaggtccatccagatgacgtggacaagcttagggagcagctcagcacctcggagaacgcgttgaccggcaggatcctggatttgaaaacagggaccgtcaaaaaggagggtcaacaatcaagcatgaggatgtgcatgggcagtagaagatctttcatttgcaggatgcgctgtggatcttcatctgtggatcctgtgagcgtgaatagactttcttttgtgcgtaatcgatgtcggaatggtctcgggtcggtcaaggacggagagcctcatttcgtcgtcgtgcactgtactggctacattaaagcgtggccacctgcgggtgtttctctcccagatgatgaccctgaggctggccagggctccaagttttgcctggtagctatcggcagactccaggtgaccagcagcccaaattgcactgatatgtccaacgtttgccaacctaccgaattcatctctagacacaacattgaaggaatcttcaccttcgtcgaccacagatgcgtggcaactgtaggataccaaccgcaggaacttctgggcaaaaacatcgtggaattttgccacccagaagatcagcagctgctaagggacagctttcaacaagtggtaaaattgaaagggcaggttcttagcgtcatgtttaggtttaggagcaagaaccaggaatggctttggatgagaacctcatcattcacctttcaaaacccttactccgacgagattgagtacatcatctgtaccaacaccaacgttaagaattcctcccaggagcctagaccgactctttctaatacgatccaaagacctcagctagggcctaccgcaaacctgcccctggagatggggtctggtcagctggctcccaggcagcagcaacaacaaactgaacttgacatggtgcctggccgggacgggttggccagctacaaccattctcaagttgtccagccggtcaccaccaccgggcctgaacactccaagccgcttgagaaaagtgacggactcttcgcccaagaccgagacccacgcttttctgaaatataccacaacatcaacgccgatcagagcaaagggatatcatcttctaccgtacctgctacccagcagctgtttagtcagggcaacacctttcctccgacgccccggcccgcagaaaatttccgcaacagtggacttgctccacctgtgaccatcgtgcagcccagcgccagcgcggggcagatgctggcccaaatttccagacattctaatcccactcagggagctaccccaacctggacccctacaacaaggtccggcttctcagcgcaacaagtcgctactcaggccacagccaaaactcggacttctcagttcggagtgggttcattccagacaccgagttcattttcaagcatgagccttccaggggctccgaccgcatcacctggggcagccgcttacccatccctgacaaacaggggcagcaatttcgcccctgaaacaggtcagacagctggacaatttcagacaaggaccgcagaaggagttggggtttggccacagtggcagggacagcagccacaccacagatcctcgagctccgaacagcacgtccaacagcctccggcccagcagccaggtcagcctgaggtgtttcaggaaatgctgtcaatgctgggagatcagtccaactcttacaacaatgaagaatttcctgacctgacaatgttcccacccttcagcgaa

SEQ ID NO: 26147 - DNA, 2367 bp, Artificial Sequence
  Description of Artificial Sequence: Synthetic coding sequence
atggctgcgactacggcaaatcccgaaatgacaagcgatgtgccatcattggggccagctattgcatcgggaaactcgggacctgggatccagggggggggcgccatcgtccagcgagcgattaagcggagacccggacttgatttcgacgacgacggagaggggaacagcaaattcttgcgctgtgacgatgaccagatgtcaaatgacaaagagcgtttcgcgcgatccgacgatgagcaatccagcgctgacaaggaaagattagcgcgcgagaaccactctgaaattgagcgccgccggcggaacaagatgacagcttacattaccgagctgagtgacatggtgccaacatgctccgccctcgcacggaagcccgataaactgacaatattgaggatggcggtgagccatatgaagtctttaagaggaacaggtaacacatctacggatggtagctacaaaccttcctttctgactgaccaggagctgaagcacctgattttggaggcagctgacgggtttttattcatagtgtcctgcgaaacaggtagagttgtgtacgtgtcagactctgtgacaccagtgcttaatcaacctcagtctgagtggtttggtagtacactgtacgatcaggtgcacccagacgatgtggacaagttacgggagcaactctctactagcgaaaatgcactgacaggccgcatattagacctaaagacaggcaccgtaaagaaggaaggtcagcaaagttccatgcgaatgtgtatggggtcacgcagaagttttatatgcaggatgcggtgcgggagttccagtgtggaccccgtgagtgtgaaccgcctgagtttcgtgcgaaataggtgtcggaatgggctcggtagcgtgaaggacggagagccccactttgtcgtcgttcactgcacgggctatatcaaggcgtggcctccagctggcgtgagcttaccagacgatgatcctgaagctggacagggatctaagttctgtctggtggccatcggtagactgcaggtaaccagctcccccaattgtaccgacatgtcgaacgtgtgccagccaacagaatttatctccaggcacaatatcgaggggattttcacctttgtagatcatcggtgtgttgctacagtaggttatcaaccgcaggagcttctgggaaagaacatcgtggaattttgtcatccagaagaccagcaactgcttcgggattccttccaacaggttgtcaaattgaaaggtcaggttctctccgttatgtttagattccgttccaaaaatcaggaatggctgtggatgcggacgtcaagcttcacatttcagaacccctattctgacgagattgaatacatcatctgcaccaatactaatgtgaagaacagcagtcaggaaccccgccctaccctgagcaataccattcagagaccccagcttggccccaccgcaaatctacctctggaaatgggatctggccagttagcgcctagacagcagcaacagcagaccgagcttgacatggtccctggccgcgatggccttgcatcttataaccactcacaagtcgtgcagccggtgactactaccggcccggagcactcgaagccgttagagaaaagcgacggcctctttgcacaagaccgcgatccaaggttcagtgaaatctaccacaacatcaatgccgatcagagcaaaggaataagctcttccactgtgccagccacacagcaacttttctcgcagggtaacactttcccgcccaccccaagaccggcagagaatttcagaaatagcgggctggcaccccctgtgacgatagtccagccatccgcatctgcaggtcaaatgcttgcgcagataagcaggcatagcaatcccacacagggggcaacccccacatggacacccaccaccagatccggcttttctgctcagcaggttgccacccaggctacggccaagaccaggaccagccagtttggagtgggtagcttccagacacccagctcattctcaagtatgtccctgccgggcgctccgaccgcttcccccggggctgcagcctatccaagcctgacaaatcgcggttctaattttgcccctgaaacaggacagactgcgggccagttccagacccgtacggccgagggcgtaggcgtgtggccgcagtggcaaggccagcaacctcaccaccggtctagcagctcagaacaacacgtacagcagcctcccgctcagcaaccgggacagccagaggtattccaggaaatgctgtcaatgctgggggatcagagcaactcctataacaacgaggagtttcctgacctaaccatgttccccccctttagcgag

SEQ ID NO: 26148 - DNA, 2367 bp, Artificial Sequence
  Description of Artificial Sequence: Synthetic coding sequence
atggcagcaaccacggcaaaccctgaaatgacgtcggatgtgccatcactgggcccagccattgcatcaggcaactcagggccagggatccaaggtgggggtgcgatcgtgcaacgcgccatcaaaaggcgaccaggcctcgatttcgacgatgacggagaaggtaactcgaagtttctgcggtgcgacgatgaccagatgtccaatgataaggagagattcgcacgaagcgatgatgagcagtcgtcggcggacaaggagcgactggcgagagaaaatcacagcgagattgagaggaggagaagaaacaagatgaccgcatacatcactgagctttcggatatggtgccaacctgctcagcacttgcgaggaagcccgacaagctgaccattcttagaatggcagtgtcacatatgaaaagcctgcgtggtactggaaatacctcgaccgatggtagctacaaaccatcctttctgacggatcaagagttgaagcaccttattcttgaagcggctgatggttttcttttcatagtgtcatgcgaaactggaagggtggtctacgtcagcgattccgtgactcctgtccttaatcagccccagtccgagtggtttggttcgaccctgtacgaccaagtgcatccagacgatgtcgataagcttcgcgaacaactttcaacttcagaaaacgcacttactggacgtattctggatctcaaaactggaactgtgaaaaaggaagggcagcagagctcgatgcggatgtgtatgggatcgagacgatccttcatatgtcggatgcgctgcggctcgtcgtcagtggatcccgttagcgtcaacagactcagcttcgtgcggaatcgatgtcggaatggactgggatccgtgaaggacggagaacctcacttcgtggtcgtgcactgtaccgggtacattaaggcgtggccacctgctggcgtgtcactgcctgacgatgacccggaagccggtcaaggttctaagttttgtctggtggccattggtcgcctccaagtgacttccagcccaaactgcaccgacatgtccaacgtctgtcagccaaccgaattcatctcccgccataacatcgaagggatctttaccttcgtcgaccaccgctgtgtcgcaaccgtcggatatcaaccacaagaattgctcggaaagaacattgtggaattctgtcatccggaggatcagcagttgctgagggactcatttcagcaagtggtgaaactcaagggccaggttctctccgtgatgttcagatttcggtccaagaatcaggaatggctgtggatgcgtacctcgtcctttactttccaaaacccttactccgacgagatcgaatacatcatttgtaccaacaccaatgtgaagaattcctcgcaagagccacgccctaccctttcgaatactattcaacgccctcagctcggccctactgcaaatcttccacttgaaatgggctcagggcaacttgcacctagacaacaacagcaacaaactgaactggatatggtccccggaagagacggtcttgcatcatacaaccatagccaggtggtgcagcctgtgaccactaccggaccagaacacagcaagccattggaaaagagcgatggactcttcgcccaagatcgggatcccagattttcggagatctaccataacataaacgccgatcaatcgaaaggcatttcatcgtcgaccgtgccagcaactcagcaactgttctcgcaaggtaatacctttcctcctactcccagacccgctgaaaactttagaaactccggactggcgcctccggtcactattgtgcagccgtcagcatcggcaggacagatgctggcccagatttcccgccattccaacccgacccaaggcgcaacgcccacttggacccccaccactaggagcggattttcggcgcagcaggttgccacccaggccacggctaaaacccggacttcccagtttggcgtgggcagctttcaaacgccatcatcgttttcgagcatgtccctgccaggagcacccactgcaagccctggagcagccgcatacccctctctcaccaaccgtggatccaacttcgcccctgaaacgggacaaaccgctgggcaatttcaaaccagaactgcagagggggtcggagtgtggcctcagtggcagggtcagcaacctcatcatcggagcagctcctcagagcaacatgtccagcaacctccagcacaacaaccgggacagcccgaggtctttcaagaaatgctttccatgctgggtgatcaaagcaactcctacaataacgaagaatttcctgatctgactatgtttcctcctttttccgaa

SEQ ID NO: 26149 - DNA, 2367 bp, Artificial Sequence
  Description of Artificial Sequence: Synthetic coding sequence
atggccgccacgacagccaatcctgagatgacttctgacgtcccatctcttgggcctgctattgcttctggcaattccgggccaggaattcagggaggcggtgcaatcgtgcaaagggcaatcaaacggcgccctgggctcgatttcgatgatgatggggaaggcaatagtaaattcctgagatgtgacgacgatcaaatgagcaatgataaagagagattcgctaggtctgacgacgagcagtccagtgcggataaggaacgcctggcacgcgagaatcattcagagattgagaggagacgccggaacaagatgactgcttacattaccgaactctccgacatggttccaacatgctcagcactggcccgcaaacctgacaaactgacgattcttcgcatggccgtcagtcacatgaagagccttcggggcacagggaacacctctactgatgggtcatacaaaccttccttcctgaccgatcaggaactgaagcatttgatcctggaggccgccgacggtttccttttcattgtctcttgcgaaaccgggcgagttgtctacgtttccgattcagtcaccccggttctcaaccaacctcagagcgaatggtttggctccaccctctatgaccaagtccatccagatgacgttgacaagctccgagaacaactcagtacgtccgagaacgccctgaccgggcgaattctcgatctgaagacgggaacagttaagaaagaaggccaacagagttctatgcgcatgtgtatgggctctagaaggagctttatctgccgaatgcgatgcggtagctctagtgtggaccccgtctccgtcaaccgcctgtcattcgtgaggaatcgatgccggaacggtctcgggtccgtgaaggacggggagccccactttgtcgtggtacattgcacaggatatataaaagcttggccgccggccggcgtgagtttgcccgacgacgatccagaggccgggcagggttctaagttctgtctcgtggccatcggccgactccaggtcacatcctcccctaactgcaccgacatgagcaacgtgtgtcagccgacagagtttattagccgccacaacatcgagggcatctttacattcgttgaccacaggtgcgtcgcaaccgtcgggtatcagccccaggagcttctgggcaagaacatagtggaattctgccacccagaagaccagcaacttcttagagactctttccagcaggttgtaaaactgaagggacaggttctgtccgtgatgttcaggtttcgctcaaaaaaccaagaatggttgtggatgaggacatccagttttacctttcagaatccttattcagacgaaatcgaatatatcatctgcacaaacaccaacgtgaagaatagttcccaggaaccgaggcctactctgtcaaacaccattcaacggccccagctgggacccacagcaaatcttcccctggaaatggggagcggacagctggctcccaggcagcagcagcaacagactgagctggacatggtccccggcagggacgggctggccagctacaaccactcccaagtcgtgcagcccgtgacgaccactgggcccgagcactctaagccactcgagaagagcgacggactttttgcgcaggacagggaccctcgcttcagcgagatctatcataatattaacgccgaccaatccaaaggcatctcttcaagcaccgttcctgcaacacagcagctgttttcacagggaaatacgttccctccgacgcctcggcctgctgagaatttcagaaattccgggctcgctccaccagtgaccatcgtacagccaagcgctagtgccggccagatgctggcgcagatcagcaggcatagcaaccccactcaaggagctacaccgacgtggacccccaccacacgctccgggttctccgcacagcaggtggcgacccaagctacagcaaagaccaggactagccagtttggcgttggctccttccagacaccctcttctttctccagcatgtcacttccgggggcccccacggccagccctggtgcagcagcgtatcccagcctgaccaataggggatccaatttcgctcccgagaccgggcagaccgctggacaatttcaaactagaacagcggagggagttggcgtctggccccagtggcaggggcagcagccacaccaccggtcatcttcatccgagcagcatgtccaacagccccccgcccagcagccaggacagcccgaagtgtttcaggagatgctcagcatgttgggtgatcaatccaatagctacaataatgaggaattccctgacctgactatgttcccgcccttttcagag

SEQ ID NO: 26150 - DNA, 2367 bp, Artificial Sequence
  Description of Artificial Sequence: Synthetic coding sequence
atggccgccactaccgccaaccctgaaatgaccagcgacgtcccttcactcggacctgctatcgccagtggaaacagcgggccaggaattcagggcggtggtgctatcgttcagcgtgctattaagcgcagaccaggccttgactttgacgatgacggggaaggtaactcgaaattcctgcggtgcgacgatgaccagatgtccaacgacaaggagcggtttgcaagatcggatgatgagcagtcctctgccgacaaagagcggttagcccgcgagaaccacagtgaaatcgagaggcgccggagaaataagatgacggcgtatataaccgagcttagcgacatggtcccaacatgctcggctctggcccgaaagcccgacaagcttaccatcctgcggatggctgtctctcacatgaaatcactgcggggaacgggcaacacgagcaccgacgggagttataagccctcttttctcacagatcaggagctcaagcaccttatcctggaggcagcagacggattcctgttcatagtttcatgtgagaccggaagagtcgtatatgtatcggactcagtcactccagtcctgaaccaacctcagagcgagtggtttgggagcaccctctatgatcaagtccatccagacgatgtggacaagctccgtgaacagctgtccacctcggagaatgcactgactggtagaatcttggatctcaagactggcaccgtgaagaaggagggccaacagtcatctatgagaatgtgcatgggcagccgccgatcgttcatatgccggatgcggtgtggcagctctagcgttgatcccgtttccgttaatcgcctcagctttgttcggaaccggtgcaggaacggcctcgggagcgttaaggacggcgagccacatttcgtagttgtacactgcaccggatacattaaagcgtggccgcccgctggcgtctccctgcccgatgacgatcccgaggccgggcagggaagcaaattttgtctggtcgccatcggcagactccaggtaacatcctctccaaactgcacagatatgtcaaatgtctgtcagccaacagaattcatcagtcgccacaacatagagggtatcttcacctttgtggaccataggtgcgtcgccacagttggatatcagcctcaggagctgctcggcaaaaatatcgtcgaattctgccatccggaggatcagcagctgctccgggactcatttcaacaagtcgtgaaactgaaaggccaggtgctgtcggtcatgtttaggtttcggtctaaaaaccaggaatggctttggatgcgaacatcctcattcacttttcagaacccatactcagacgaaatagagtatatcatttgtaccaatacaaatgtaaagaactcatcacaagagccaagacccaccctgtcaaacaccatccagcggccgcagttgggtcccacggcaaatctccccctagaaatgggaagcggacagctcgcgccccgccagcagcaacagcaaacagaactagatatggtgccggggagagacggactggcgtcatataaccactcacaagtggtgcaaccagtaaccaccacagggccagaacactccaaacccttagagaagtctgatggtctatttgctcaggatagggacccaaggttcagcgagatttaccataatatcaatgccgatcagtccaaaggtatctccagttctacagttcctgccacacagcaactgttcagccaggggaacacattcccaccaacgcctcgccccgccgagaactttcggaactcagggctcgctccgcccgtgactatcgtgcagcccagcgcatctgcagggcagatgctcgcccagatatccaggcacagcaacccaacacagggtgcaacacctacatggaccccaaccacaagatcagggttttccgcgcagcaggttgcaactcaggccacagccaagactcggacatctcagttcggagttgggtctttccaaactccctccagcttcagttcaatgagcctacccggggcccctacagcctcccctggagcggcagcttacccaagtctgacaaacagagggtctaatttcgcccccgagactggacagacagctggccaatttcagacccggacagcagagggggtcggagtatggcctcagtggcagggacagcagccccaccaccgatcttcctcgagcgaacagcacgttcaacagcccccagctcagcaacctgggcagccagaggtatttcaggagatgctatcaatgcttggtgatcaatctaacagctacaacaatgaggagttccccgacttgactatgtttcctccttttagcgag

SEQ ID NO: 26151 - DNA, 2367 bp, Artificial Sequence
  Description of Artificial Sequence: Synthetic coding sequence
atggctgcgaccaccgctaatcccgaaatgacctcagatgtaccgtcgctaggacccgccatagccagcggcaatagcgggccaggtattcaaggaggtggcgccatcgttcagcgagctattaaaagacgacctggcctagactttgatgacgacggagaagggaattcaaaatttctacgatgtgatgacgaccagatgagcaacgacaaagaacgattcgccagaagcgacgacgaacagtcatccgccgataaagagcggctggcccgcgagaatcactcagagattgagaggagacggaggaacaaaatgaccgcatacatcacagaattgtcagatatggttcctacttgctcagcactggcgcgtaagccggacaaactcactattctgcggatggcggtgagtcacatgaagagtttgagaggcacgggcaacacatctacagacggcagctataagccaagtttcttgacggatcaggagctgaaacatctcatcctcgaagcggccgacggttttttgtttatagtgtcttgcgagactggtagggtggtgtacgtgagtgatagcgtaactccagtcttgaatcagccccagagcgaatggtttggttctactctctacgaccaggttcaccccgacgatgtcgataaactgagggaacagctgtcaaccagcgagaatgctctcacgggcagaatactggatctgaaaacaggaaccgtgaaaaaggagggccaacagtctagtatgagaatgtgtatgggctcaaggagaagctttatctgcaggatgcggtgcgggtcaagctccgtcgaccccgttagcgtgaaccggttatcttttgtgaggaatcggtgtcgcaatggattgggttccgttaaggatggcgagccacactttgtggttgttcactgtaccggctacatcaaagcgtggccccctgctggagttagcctgcccgacgacgaccctgaggcgggacagggaagcaaattctgcctggtcgccattggccggctgcaggtgacttcaagtcccaattgtaccgatatgagcaatgtttgtcaacccacggaattcatctcccgacacaacattgaggggatttttacgtttgtagaccacaggtgcgttgccaccgttggataccaaccccaagaactgctaggtaaaaacatagtggaattttgccacccagaagaccagcagctgctgcgagatagcttccaacaggttgtcaaattgaagggtcaggtcttgagtgtgatgtttaggttcaggtccaagaatcaggaatggttatggatgaggacctcctccttcacttttcagaacccttattccgatgaaatagaatacattatctgtacaaatacaaacgtgaaaaactcttctcaggagccgcgtcctacactcagcaatactattcagcgtcctcagctcgggccgacagctaatttacccctggagatgggatcagggcaactggcccctcgccagcagcagcaacagacggagctggacatggtgcccggaagagacgggctggcgagttataatcatagtcaggttgtccaacctgtgactaccacagggcctgagcactccaagccactcgagaagtccgacggcctgttcgcgcaggaccgggacccgaggttcagcgaaatttaccacaatattaatgccgaccagtcaaaggggatcagctcatctaccgttcctgccacccagcaattgttctcacaggggaatacattccctccaaccccccgacccgcagagaacttcaggaacagtgggctcgctccccctgtgacgattgtccagccttctgcctctgcgggccagatgctagcacagataagtaggcacagcaaccctactcagggggctacccccacttggaccccaaccacccgcagcggcttctcggcacagcaggtcgccactcaagcgactgccaaaactcgcacatcacagttcggagtgggtagcttccagactcccagcagcttctcgtctatgagcttaccgggggctcctacagcctccccaggtgccgcagcctaccccagcctgacaaatcggggcagtaacttcgcgcccgagacaggccagaccgctggccagttccagactcgaaccgccgaaggggtcggcgtttggcctcagtggcagggccagcaaccacatcaccgctcttcttcctccgagcagcatgttcagcaacctcccgctcagcagcctggccagccggaagtcttccaggagatgctgtctatgcttggcgatcagtcaaacagctacaacaatgaggagtttccagatctgaccatgttcccgccgttttccgaa

SEQ ID NO: 26152 - DNA, 2367 bp, Artificial Sequence
  Description of Artificial Sequence: Synthetic coding sequence
atggctgcaactacagcaaaccccgagatgaccagcgatgtgccaagcttgggacctgcaatcgcatccggcaactctggccccggaatacaggggggtggagccatcgttcaacgagccatcaagagaaggcccggtctggacttcgatgatgatggagaggggaatagtaagtttcttcgatgcgatgatgaccagatgagcaatgataaagaacggtttgcacggtccgacgatgagcagtctagcgcagataaagagaggttagctagagaaaaccactccgaaatcgaacgcaggcgacggaataagatgaccgcatatatcaccgagttgagcgacatggtccccacctgcagtgcccttgctagaaaaccagataagcttactattctgagaatggctgttagccacatgaaaagtctcagagggaccgggaacacatcgacagatggaagttacaagccttcctttcttacagaccaggaactgaagcatctgattttggaggctgccgacggtttcctctttatcgtcagttgcgaaactggacgggtcgtgtacgtctccgactccgtgactccagtcctgaatcagccgcagagtgagtggtttgggagcaccctgtatgatcaagtgcatccagacgatgtggacaaactgcgggagcaactctctacttccgaaaacgcactgaccggcaggattcttgatctcaagactggcaccgtcaaaaaagaaggtcaacagagttctatgaggatgtgtatgggcagccggagatcatttatttgccgcatgagatgcggcagctctagcgtggaccccgtttcagtcaatagactgagcttcgtcagaaataggtgtcgcaatggtcttgggtcagtgaaggatggggagcctcatttcgtagtcgttcactgtaccggatacattaaagcttggccgcctgctggcgtatccctgcctgacgatgatccagaggcaggccaggggtcgaagttttgtcttgtggcgatcgggagacttcaggtgacaagctcaccaaattgtacagatatgtccaatgtgtgccagcccacagagttcattagccgccataacatcgaaggcatcttcacttttgtggaccaccgctgcgtggctactgtgggataccaaccacaagaattactgggcaagaacatcgttgaattttgccacccagaggaccaacagctgctgcgagactcattccaacaggttgttaaactgaaaggccaggttctaagcgtgatgtttcgcttccgttcgaagaaccaggaatggttgtggatgagaactagcagtttcacattccagaatccgtacagcgacgagatcgaatatataatatgtacaaacactaatgtaaagaatagctctcaggagcccagaccaactttaagcaatacaatccagaggccccaactcggaccgacagcaaacctgccactagaaatgggtagcgggcagctcgctcctcggcagcagcagcaacagacggaactcgatatggtgcccggtcgggacggactcgcatcatataaccattcccaagtagtccaacctgttaccaccactggacccgaacatagcaaaccgctagaaaagagcgacggactgtttgcacaggaccgcgatccacggttcagcgagatataccacaacatcaacgctgatcaatctaaaggaatctcatccagtacggtgcccgccacccaacaactgtttagccaaggcaacacatttcccccaacacctagacctgcagaaaactttagaaattccggcctcgcacccccagtgaccatcgtgcaaccatctgccagcgctggtcagatgctggcccagatctccaggcattccaaccctacccagggcgctacccctacgtggacacctaccactagaagcggcttcagcgcacaacaggttgctactcaggctaccgcaaagacccggacaagtcaattcggtgtgggctctttccaaaccccttcatctttttcttcaatgtccctacctggtgctccgaccgcgagccctggggcagctgcctacccaagcctgaccaacaggggctccaatttcgctccagaaacaggacagaccgctgggcaatttcaaacccgtaccgcagagggcgtgggcgtgtggccgcaatggcaaggacagcagccccatcacagaagcagctcatccgagcaacatgttcaacaaccccctgctcagcagcctggacaacctgaagttttccaagagatgctcagcatgctgggcgatcagtccaactcctataacaacgaggagtttcccgatctcaccatgttcccacctttttctgag

SEQ ID NO: 26153 - DNA, 2367 bp, Artificial Sequence
  Description of Artificial Sequence: Synthetic coding sequence
atggcagctacaactgccaatcccgaaatgaccagcgatgtcccttccctcggtccagctatagcctccggtaacagtggtcccggaatacaaggaggaggagccattgtccagcgggcaataaaacgtagacccggtttggactttgatgacgacggcgagggtaatagcaagtttctgcgatgcgacgacgatcagatgagcaacgataaggagaggtttgccagatctgatgacgagcagtcttccgccgataaggagaggctggctcgggaaaatcacagtgagatagaacggcgacgtagaaacaagatgaccgcatacataacagagctgtcagacatggtcccaacgtgtagtgcacttgcccggaagccggataaactgactattctgcgtatggcagtttctcatatgaaaagcctacgagggaccgggaatactagtacggatggatcttataagccttcattcctgacagatcaagaacttaagcatttgatcctggaggccgccgacgggttcttgtttatcgtgtcctgcgaaactgggcgggtggtgtacgtgagcgacagtgttacccccgtactgaatcagccgcagtctgagtggttcgggagcacactctatgaccaggtccaccctgacgatgtggataaactcagagaacagcttagtaccagcgagaacgccctgacagggaggattctggacttaaagaccggaaccgtaaagaaggagggtcaacaaagttctatgcgaatgtgcatggggagtcgccgcagcttcatttgccgaatgcggtgcggctcttcctcagtcgatccagtgtccgtgaaccgtctgagttttgtgaggaatcgctgccggaacggcctgggcagcgtgaaagatggcgagccccatttcgtcgtagtgcactgtactggatatatcaaagcgtggcctccagccggcgtcagtctgcccgacgatgatccggaggcaggtcagggcagcaaattctgcttggtcgcaattgggagacttcaggtgaccagctctcccaactgtactgacatgagcaatgtgtgccagcctaccgagttcattagtagacataatattgagggaatatttacctttgtcgaccacaggtgcgtcgccactgttggataccaacctcaagaactcctgggcaagaatatagttgagttctgccacccagaggatcagcagctgttgagggactcttttcagcaggttgttaaacttaagggacaggtgctgagtgtgatgtttaggttcaggtctaagaaccaggagtggctgtggatgcggacatcctcgttcacattccagaatccttactcagacgaaatcgaatatatcatctgcacaaacacgaatgtgaaaaacagcagccaggagccccggcccaccctgagtaacactatacagcgcccacagctcggccccacagccaacctccccctggagatgggctccggtcagctggctccaaggcaacaacagcagcaaacggaacttgacatggttcctggtcgagacgggctggcttcatacaaccattctcaagttgtgcagcccgtcaccacgactggtccagaacacagcaagcctctggagaaatcagatggcctgtttgcccaggacagggatccccgcttttccgaaatataccataacattaacgccgatcagtccaagggcatttcatcctctaccgtgcccgccacacagcaacttttctcccaggggaacacctttcctcctactcctcgccctgcagagaactttcggaattcaggactggctcctcccgtgacaattgttcaaccctctgcttctgctggccagatgctagcccagattagccgacatagcaacccgacccagggagcaacgccaacctggacgccaaccactagaagcggattctctgcacagcaggtagctacgcaggcaaccgcgaagactaggacctcacaattcggcgtaggcagcttccaaacacccagttcgttctcgagcatgtcccttcccggggctcctaccgcctcaccgggcgctgccgcctaccccagtctaaccaatagaggatctaactttgctccagaaaccggccagactgcagggcagttccagacacgtaccgccgaaggggttggcgtgtggccccaatggcaggggcagcagccccaccacaggagttcctccagcgaacaacatgtgcagcagccacccgcgcagcagcctggtcagccagaggtattccaggagatgctttctatgttgggcgatcaaagtaacagctataataacgaggaatttccagacctgactatgtttccgcccttttccgag

SEQ ID NO: 26154 - protein, 4 aa, Homo sapiens
  MOD_RES (2)..(3): Any amino acid
RXXR

SEQ ID NO: 26155 - protein, 4 aa, Homo sapiens
  MOD_RES (2)..(2): Any amino acid
  MOD_RES (3)..(3): Lys or Arg
RXXR

SEQ ID NO: 26156 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 26157 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 26158 - protein, 6 aa, Homo sapiens
LVPRGS

SEQ ID NO: 26159 - protein, 4 aa, Homo sapiens
LVPR

SEQ ID NO: 26160 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 26161 - protein, 4 aa, Homo sapiens
IEGR

SEQ ID NO: 26162 - protein, 4 aa, Homo sapiens
IDGR

SEQ ID NO: 26163 - protein, 4 aa, Homo sapiens
AEGR

SEQ ID NO: 26164 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 26165 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 26166 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 26167 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 26168 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 26169 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 26170 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 26171 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 26172 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 26173 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 26174 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 26175 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 26176 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 26177 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 26178 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 26179 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 26180 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 26181 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 26182 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 26183 - RNA, 806 nt, Artificial Sequence
  Description of Artificial Sequence: Synthetic coding sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 26184 - RNA, 1573 nt, Artificial Sequence
  Description of Artificial Sequence: Synthetic coding sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 26185 - RNA, 1568 nt, Artificial Sequence
  Description of Artificial Sequence: Synthetic coding sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 26186 - RNA, 863 nt, Artificial Sequence
  Description of Artificial Sequence: Synthetic coding sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
